(12) United States Patent
Pogliano et al.

(10) Patent No.: US 8,636,999 B2
(45) Date of Patent: Jan. 28, 2014

(54) STABLE PLASMID EXPRESSION VECTOR FOR BACTERIA

(75) Inventors: Joe Pogliano, San Diego, CA (US); Alan Derman, San Diego, CA (US)

(73) Assignee: The Regents of the University of California, Oakland, CA (US)

( * ) Notice: Subject to any disclaimer, the term of this patent is extended or adjusted under 35 U.S.C. 154(b) by 0 days.

(21) Appl. No.: 13/378,516

(22) PCT Filed: Jun. 16, 2010

(86) PCT No.: PCT/US2010/038892
§ 371 (c)(1),
(2), (4) Date: Mar. 1, 2012

(87) PCT Pub. No.: WO2010/148140
PCT Pub. Date: Dec. 23, 2010

(65) Prior Publication Data
US 2012/0184019 A1    Jul. 19, 2012

Related U.S. Application Data

(60) Provisional application No. 61/187,592, filed on Jun. 16, 2009.

(51) Int. Cl.
*A01N 63/00*     (2006.01)
*C12N 15/00*    (2006.01)
*C12N 15/74*    (2006.01)
*C07H 21/04*    (2006.01)

(52) U.S. Cl.
USPC ....... 424/93.2; 435/320.1; 435/471; 536/23.7

(58) Field of Classification Search
USPC .............. 424/93.2; 435/320.1, 471; 536/23.7
See application file for complete search history.

(56) References Cited

PUBLICATIONS

Copeland et al., 2007, GenEmbl Accession No. CP000679, computer printout pp. 4-8.*
International Search Report and Written Opinion from PCT/US2010/038892, dated Mar. 17, 2011.
Becker, et al.; "DNA segregation by the bacterial actin AlfA during *Bacillus subtilis* growth and development"; *The EMBO Journal*; 25:5919-5931 (2006).
Sato et al.; "Alp7/TACC is a crucial target in Ran-GTPase-dependent spindle formation in fission yeast"; *Nature*; 447(7142):334-337 (2007) *Epub* May 2, 2007.
Tanaka, T.; "Functional analysis of the stability determinant AlfB of pBET131, a miniplasmid derivative of *Bacillus subtilis* (natto) plasmid pLS32"; *Journal of Bacteriology*; 192(5):1221-1230 (2010) *Epub* Dec. 18, 2009.

* cited by examiner

*Primary Examiner* — Shin-Lin Chen
(74) *Attorney, Agent, or Firm* — Kilpatrick Townsend & Stockton LLP

(57) ABSTRACT

The invention provides compositions and methods for stable plasmid maintenance and protein expression in bacteria. Further provided are compositions and methods for promoting competence in bacteria that are otherwise not transformable.

9 Claims, 10 Drawing Sheets

FIGURE 1
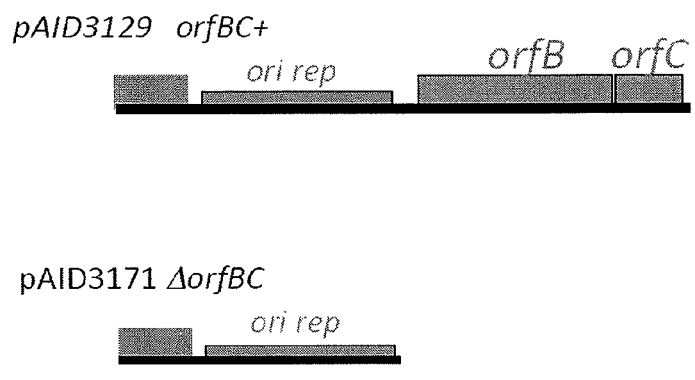
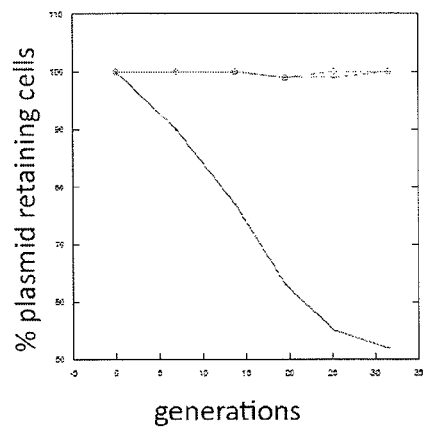
Plasmids containing the orfB stability system are very stably inherited in *Bacillus*.
Plasmids without it are lost from the population as cells grow and divide
In the absence of antibiotic selection.

FIGURE 2
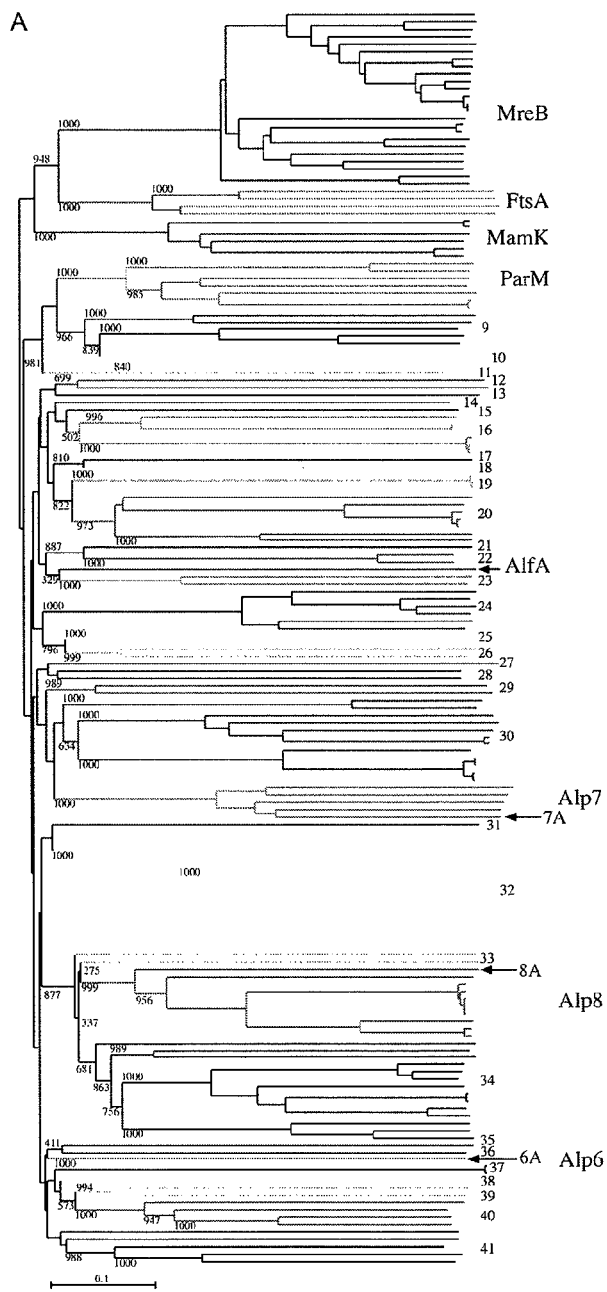
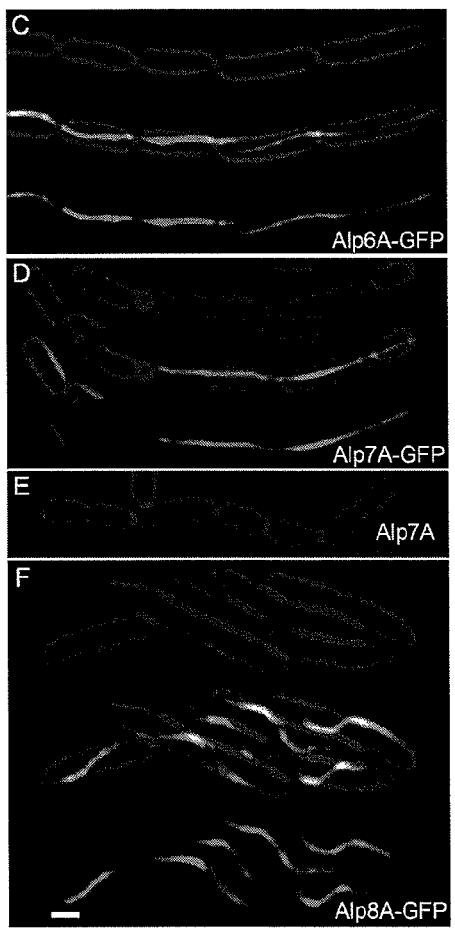

FIGURE 9

| Primer | Sequence |
|---|---|
| P1 | 5'-CTGTAGGTACCGCCATAGATATGTAGTACAACAATC-3' |
| P2 | 5'-GACTATCGATGCCATGTGCAATCAGCCTTC-3' |
| P3 | 5'-CTGTAGGTACCGCCATAGATATGTAGTACAACAATC-3' |
| P4 | 5'-AATCGCGGTACCATTATTTGTAGAGCTC-3' |
| P5 | 5'-CTGTAAGCGCTGCTAATGTGGAAGGAACAAG-3' |
| P6 | 5'-GTACTCGGCCGATCGATGCTAGCTGTCTCTGGCACTTTATG-3' |
| P7 | 5'-CTGTAGGTACCGTAGTGCGCCAAGCAACCTAGTG-3 |
| P8 | 5'-GTACTATCGATGCTAGCAATTGATTGTGCCTCTTTTTCATTTGCCTG-3' |
| P9 | 5'-CTGTAGGTACCTAATGAGATGCTAGTATTGAGGAAAGTG-3' |
| P10 | 5'-GTACTGCATGCGTTGCTCAGGGCGTCTGTGTTG-3' |
| P11 | 5'-CTGTAATGCATTCATTAGCCTCCAATCTTATAGTGAAACTCCGCAAACTTC-3' |
| P12 | 5'-GTACTGCTAGCGTTGCTCAGGGCGTCTGTGTTG-3' |
| P13 | 5'-GAGAGAATAAAAATATGAATATTTCTCCTAGGGAGGCACAATCAATTTAGGTG-3' |
| P14 | 5'-CACCTAAATTGATTGTGCCTCCCTAGGAGAAATATTCATATTTTTATTCTCTC-3' |
| P15 | 5'-ATCAATGCATCTGTAGACAAATTGTGA-3' |
| P16 | 5'-ATCAATGCATGCTGGATACTTCCCGTCC-3' |
| P17 | 5'-GAGGCACAATCAATTTAGTGAATTCGAGCACTAGTGCAG-3' |
| P18 | 5'-CTGCACTAGTGCTCGAATTCACTAAATTGATTGTGCCTC-3' |
| P19 | 5'-CTGTAACTAGTGATGCTAGTATTGAGGAAAGTG-3' |
| P20 | 5'-GAGTCTTGCCTTTTGGGTTAG-3' |
| P21 | 5'-GACGTAGTTTTTTGTGCATTAGGTGGCGGAACAGATGATC-3' |
| P22 | 5'-GATCATCTGTTCCGCCACCTAATGCACAAAAAACTACGTC-3' |
| P23' | 5'-GCAGCGTGCAGGATCGCATCTGAAGTAGCAAG-3' |
| P24 | 5'-CTTGCTACTTCAGATGCGATCCTGCACGCTGC-3' |
| P25 | 5'-CTGTAGCTAGCAATATTTCTCGTATGAACGTGGACTTTG-3 |
| P26 | 5'-GTACTGCTAGCCTAAATTGATTGTGCCTCTTTTTCATTTGCCTG-3 |
| P27 | 5'-TTTGAATTCATGGAACTGCTCCGCAAAGGA-3' |
| P28 | 5'-TTTCTGCAGTGCAGCCGCATCTGACTGGCTGCTGAGCTTATTC-3' |
| P29 | 5'-GTACTAGATCTCAAGACTCTCCGTAGTTTAG-3' |
| P30 | 5-CTGTAAGATCTCATAAATCGCCGTGACGATC-3' |
| P31 | 5'-CCCGGAATTCGATCCCCTCCGCCGCTACCA-3' |
| P32 | 5-CCCGCGGATCCTGCTTTTTCCATTCCTCTCAT-3' |
| P33 | 5'-GGGACTAGTAAGGGCGAGGAGCTGTTCACCG-3' |
| P34 | 5'-ACGGCCGCTTGTACAGCTCGTCCATGCCGAG-3' |
| P35 | 5'-CCACTGTAAGTTCTGCCGAA-3' |
| P36 | 5'-GGGGATCCATGAAACCAGTAACGTTATACGATGTCGCA-3' |
| P37 | 5'-TTTAGATCTTCCACCTTTTCCCAAGCTTAATAAATTC-3' |
| P38 | 5'-GCTGTCAAACATGAGAATTCTTACATTGTA-3 |
| P39 | 5'-TTAAGCTTAAAGGAGGAAAATAATGAAAAATATTGAAAAAGTAAGCATGAAACCGGTTACGTTATACGATGTCGCAGAG-3 |

FIGURE 10
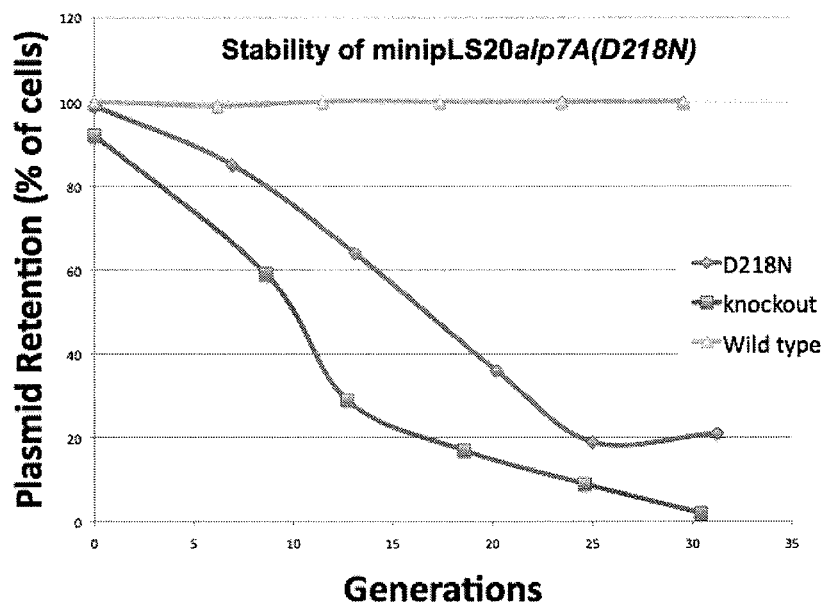
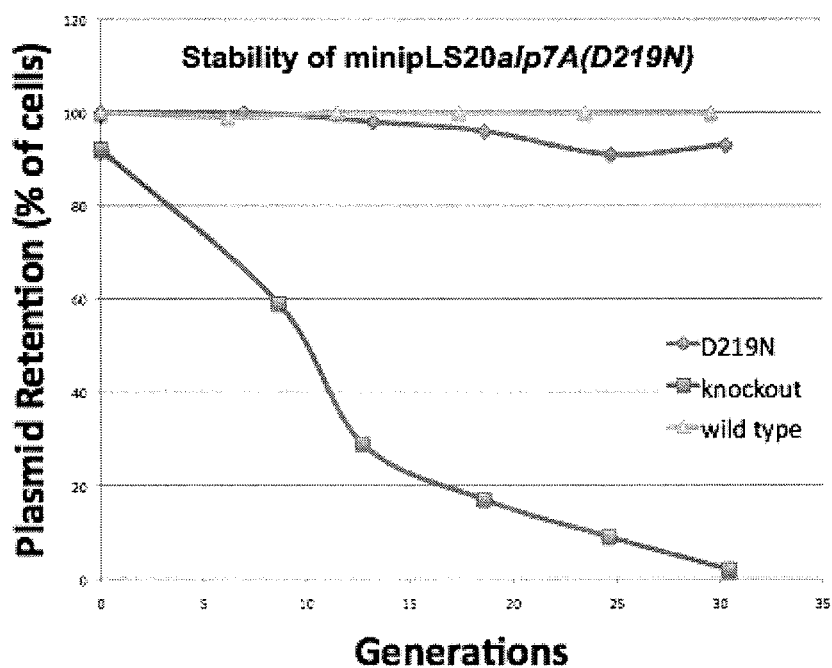

STABLE PLASMID EXPRESSION VECTOR FOR BACTERIA

CROSS-REFERENCES TO RELATED APPLICATIONS

This application is the US National Stage under §371 of International Application No. PCT/US2010/038892, filed Jun. 16, 2010, and claims priority to U.S. Provisional Application 61/187,592, filed Jun. 16, 2009, the disclosures of each are incorporated by reference herein in their entireties.

STATEMENT AS TO RIGHTS TO INVENTIONS MADE UNDER FEDERALLY SPONSORED RESEARCH AND DEVELOPMENT

The invention was made with Government support under Grant Number GM073896, awarded by the National Institutes of Health. The Government has certain rights in this invention.

REFERENCE TO A "SEQUENCE LISTING," A TABLE, OR A COMPUTER PROGRAM LISTING APPENDIX SUBMITTED AS AN ASCII TEXT FILE

The Sequence Listing written in file—38-1.TXT, created on Oct. 18, 2013, 1,216,512 bytes, machine format IBM-PC, MS-Windows operating system, is hereby incorporated by reference in its entirety for all purposes.

BACKGROUND OF THE INVENTION

The worldwide market for proteins produced from recombinant bacteria covers many business sectors beyond biotechnology and medine. The market for enzymes produced by strains of Bacillus alone is estimated to be greater than $1 billion, especially for high-level production of cellulases used to produce biofuels or for other industrial processes. The system is used for high level expression of commercially important proteins; constructing and screening libraries of genes; and complementing bacterial chromosomal mutations. In addition, many strains of Bacillus are sold by the ton commercially for agricultural use because of the their ability to produce secondary metabolites that simultaneously promote plant growth and suppress disease. However, nearly all of these commercially important strains cannot be easily manipulated genetically.

Expression in Bacillus has generally been achieved through gene integration into the bacterial chromosome at a specific site. The drawback of this is that there is only one copy per cell, and expression is not very high. Also, it is difficult to retrieve the gene from the chromosome for additional manipulations. To avoid these issues, several different types of B. subtilis plasmids that have been used, such as pUB110, pE194, pMTLBS72, or pSMbeta1. However, these plasmids are unstable and do not segregate well during cell growth, making them relatively difficult to use for gene expression. During large scale fermentation without antibiotic selection, a significant number of cells (50-99.9%) lose the plasmids. Even under selection, the bacteria may lose their plasmids unless they have this stable segregation system.

Actin, one of the most abundant proteins in the eukaryotic cell, has an abundance of relatives in the eukaryotic proteome. To date though, only five families of actins have been characterized in bacteria.

Actin is present in all eukaryotic cells and is the most abundant protein of the eukaryotic cytoskeleton. Actin participates in such fundamental processes as cell motility, endocytosis, cell remodeling, cytokinesis, and transcription (Le Clainche et al., *Physiol Rev* 88:489-513 (2008); Pollard et al., *Cell* 112:453-465 (2003); Girao et al., *FEBS Lett* 582: 2112-2119 (2008); Wanner et al., *J Cell Sci* 120:2641-2651 (2007); Pollard *Biochem Soc Trans* 36:425-430 (2008); Chen et al., *Curr Opin Cell Biol* 19:326-330 (2007)). Actin is extremely well conserved. The cytoskeletal actins of chicken, cow, and man are identical to each other across all 375 amino acids of the protein. The actin of *Saccharomyces cerevisiae* is exactly the same length, and its sequence is 89% identical to this vertebrate sequence.

This level of sequence conservation is not required for the actin fold. Actin is a member of a large superfamily of proteins that share the same fundamental architecture. In this superfamily are the 70-kDa heat shock proteins and a group of sugar and sugar alcohol kinases that includes hexokinase and glycerol kinase (Kabsch et al., *FASEB J* 9:167-174 (1995); Flaherty et al., *Proc Natl Acad Sci USA* 88:5041-5045 (1991); Bork et al., *Proc Natl Acad Sci USA* 89:7290-7294 (1992)). The actin folds of rabbit skeletal muscle actin and the 70-kDa heat shock protein from cow, two members of this superfamily, are only 16% identical at the amino acid sequence level, but can be superimposed with a root mean square deviation of 2.3 Å (Flaherty et al., *Proc Natl Acad Sci USA* 88:5041-5045 (1991)).

Long assumed to lack a cytoskeleton or cytoskeletal proteins, bacteria have in the last decade been shown to contain homologs of actin and also of tubulin and intermediate filaments (Pogliano *Curr Opin Cell Biol* 20:19-27 (2008); Graumann *Annu Rev Microbiol* 61:589-618 (2007). To date five distinct families of actin-like proteins have been identified in bacteria, and they are no more related to each other than they are to actin (<13% sequence identity). The crystal structures of members of three of these families, of FtsA, MreB, and ParM, confirmed that their classification as members of the actin family was appropriate despite the very slight resemblance of their sequences to that of actin (van den Ent et al., *EMBO J.* 19(20):5300-5307 (2000); van den Ent et al., *Nature* 413:39-44 (2001); van den Ent et al., *EMBO J* 21:6935-6943 (2002)).

MreB is found in many non-spherical bacteria and is required for the generation of proper cell shape (Daniel et al., *Cell* 113:767-776 (2003); Carballido-López et al., *Curr Opin Microbiol* 10:611-616 (2007); Osborn et al. *Curr Opin Microbiol* 10:606-610 (2007)). In *Bacillus subtilis, Escherichia coli,* and *Caulobacter crescentus*, helical filaments of MreB coil through the length of the cell at the cytoplasmic membrane (Jones et al., *Cell* 104:913-922 (2001); Shih et al., *Proc Natl Acad Sci USA* 100:7865-7870 (2003); Gitai et al., *Proc Natl Acad Sci* 101:8643-8648 (2004); Figge et al., *Mol Microbiol* 51:1321-1332 (2004)). The filaments are dynamic, moving in a treadmilling-like fashion (Soufo et al., *EMBO Reps* 5:789-794 (2004); Kim et al., *Proc Natl Acad USA* 103:10929-10934 (2006)). FtsA is a component of the bacterial cell division machinery that interacts directly with the machinery's principal component, the tubulin relative FtsZ (Shiomi et al., *Mol Microbiol* 66:1396-1415 (2007); Pichoff et al., *Mol Microbiol* 55:1722-1734 (2005)). MamK is present in magnetotactic bacteria and is required for organization into linear chains of the cytoplasmic membrane invaginations that contain magnetic nanocrystals. MamK is assembled into several filaments that flank these chains. In the absence of MamK, the invaginations are disordered and scattered (Komeili et al., *Science* 311:242-245 (2006); Schüler *FEMS Microbiol Rev* 32:654-672 (2008)).

ParM and AlfA are each nucleotide-binding components of plasmid partitioning systems. Both form dynamic filaments within the cell, and the dynamic properties of the filaments are required for partitioning (Møller-Jensen et al., *EMBO J* 21:3119-3127 (2002); Møller-Jensen et al., *Mol Cell* 12:1477-1487 (2003); Campbell et al., *J Cell Biol* 179:1059-1066 (2007); Becker et al., *EMBO J* 25:5919-5931 (2006)). The purified ParM is able to polymerize spontaneously in the presence of ATP into filaments that display dynamic instability (Garner et al., *Science* 306:1021-1025 (2004); Garner et al., *Science* 315:1270-1274 (2007)). Plasmids are found at the end of ParM filaments both within the cell and in in vitro reconstructions of the system, which is consistent with a mechanism in which plasmids are pushed towards the cell poles (Gerdes et al., *Cell* 116:359-366 (2004); Møller-Jensen et al., *EMBO J* 21:3119-3127 (2002); Møller-Jensen et al., *Mol Cell* 12:1477-1487 (2003); Campbell et al., *J Cell Biol* 179:1059-1066 (2007); Garner et al., *Science* 315:1270-1274 (2007); Garner et al., *Science* 306:1021-1025 (2004); Salje et al., *Science* 323:509-512 (2009)). Reconstructions from cryo-electron microscopy indicate that ParM filaments and actin filaments are constructed very differently. The monomer interfaces are different, and as a consequence, ParM and actin filaments are of the opposite helical handedness (Orlova et al., *Nat Struct Mol Biol* 14:921-926 (2007); Popp et al., *EMBO J* 27:570-579 (2008)).

With a mere five families of distant relatives identified, actin would appear to have only very sparse representation in bacteria. There are in contrast a great number of actin relatives that have been identified in eukaryotes, and even among these eukaryotic proteins there is considerable sequence and functional diversity. The actin-related proteins, or ARPs were discovered about twenty years ago. Although there exist structures for only Arp2 and Arp3, the secondary structural elements of the actin fold appear to be present in all of the ARPs (Muller et al., *Mol Biol Cell* 16:5736-5748 (2005)). Arp1, a component of the dynein activator complex, is the closest to actin in amino acid sequence; the sequences of *Saccharomyces cerevisiae* Arp1 and actin are 46% identical. Arp1 retains the signature property of actin: Arp1 polymerizes into filaments with the pitch of filamentous actin. Arp1 also binds ATP, and filament formation, as in actin, is accompanied by ATP hydrolysis. There are, however, differences. Kinetic profiles indicate that there is no barrier to nucleation and that the Arp1 filaments cannot be extended beyond a specific length (Bingham et al., *Curr Biol* 9:223-226 (1999)). The divergence is greater for Arp2 and Arp3, which in *Saccharomyces* are respectively 39% and 32% identical to actin. Their crystal structures, which were solved in the context of the bovine Arp2/3 complex, revealed that the actin fold is well preserved in both proteins (Robinson et al., *Science* 294: 1679-1684 (2001); Nolen et al., *Proc Natl Acad Sci USA* 101:15627-15632 (2004)). But neither protein homopolymerizes into filaments, each binds ATP with three orders of magnitude lower affinity than actin does, and Arp3 does not appear to hydrolyze ATP at all (Dayel et al., *Proc Natl Acad Sci USA* 98:14871-14876 (2001); Dayel et al., *PLoS Biol* 2:0476-0485 (2004)). The remaining ARPs diverge still further from actin. The sequences of *Saccharomyces* Arp9 and actin, for example, share only 14% identity, on the order of the bacterial actins.

A recent survey of a single eukaryotic genome, *Dictyostelium discoideum*, turned up 16 genes that code for proteins that closely resemble actin, as well as eight ARPs, in addition to 17 copies of the actin gene, (Joseph et al., *PLoS ONE* 3:e2654 (2008)).

Genetic competence is the ability of a bacterial cell to take up exogenous DNA and is key to the genetic manipulation of bacteria. In a few strains of *Bacillus*, such as *B. subtilis* strain 168, genetic competence can be induced easily, and comes about when the com genes, which encode the DNA uptake machinery are expressed during stationary phase by the transcription factor ComK. In contrast to strain 168, the vast majority of *Bacillus* strains of commercial importance cannot be readily made competent despite the fact that they contain the same com genes. The inability to activate competence severely limits the ability to manipulate these strains genetically.

In the commonly used laboratory strain *Bacillus subtilis* 168, competence requires the expression of a set of com genes whose products assemble into a complex in the inner membrane that actively translocates DNA into the cell. Expression of the com genes is under the control of the transcription factor ComK, and cells become competent when ComK accumulates in the cells. Many strains of *Bacillus* contain all of the com genes necessary for competence, but do not express them. Expression of the *B. subtilis* ComK protein in these untransformable strains is sufficient to make them competent, but because these strains are untransformable, it is difficult if not impossible, to introduce a ComK expression plasmid into these strains.

The present invention provides additional bacterial proteins that share structural and functional characteristics with actin. The invention thus provides a number of bacterial Actin-like proteins (ALPs). The ALPs can be used to confer stable segregation of any self-replicating DNA molecule (e.g., a plasmid or other expression vector) through multiple generations.

The invention overcomes the longtime limitations associated with protein expression in bacteria, and offers the ability to manipulate many different species of *Bacillus*. The ability to genetically manipulate these strains will allow their products to be produced at higher yields with increased safety and at reduced costs. The invention further provides an expression vector that is capable of being delivered directly into strains of *Bacillus* and activating the competence pathway. This general system will allow many species of *Bacillus* of industrial importance to be easily manipulated genetically.

The invention provides for the first time a plasmid vector that is stably inherited in *Bacillus* bacterial strains in the absence of antibiotic selection. The vector can be used without further development to produce heterologous proteins in bacteria. The ALPs can be used in such methods. Further included is a system for genetic competence, i.e., the ability to take up exogenous DNA, that is stably inherited.

BRIEF SUMMARY OF THE INVENTION

The invention provides a plasmid stability system that is functional in multiple bacterial species, including e.g., *Bacillus* such as *B. subtilis*. The stability system makes expression vectors significantly more stable in bacteria than in the absence of the stability system, so that the expression vector will be maintained through multiple generations (passages, divisions) of bacteria, e.g., more than 5, 10, 20, 25, 30, 35, 40, 50, or more generations. The stability system plasmid contains a novel type of DNA segregation system that segregates newly replicated plasmids prior to cell division, even without antibiotic selection. The plasmids are then maintained in the bacteria, e.g., *E. coli* and *B. subtilis*.

The invention thus provides a bacterial plasmid vector that causes the plasmid to be stably maintained in multiple species and strains of bacteria. The invention also provides plasmid vectors comprising such a sequence, optionally in combination with at least one heterologous sequence, e.g., encoding a commercially valuable heterologous protein. The invention also provides a method of expression, wherein a heterologous protein can be stably expressed in bacteria, such as a *B. subtilis* strain. Stable expression from a *B. subtilis* plasmid vector was not achievable before the present invention.

In some embodiments, the system comprises a vector encoding an actin-like polymer and a DNA binding protein. In some embodiments, the actin polymer is selected from one of the actin sequences (ALPs) disclosed herein.

The invention provides an isolated plasmid expression vector comprising a polynucleotide encoding a prokaryote-derived actin like protein (ALP), wherein the vector comprises a stability system. In some embodiments, the vector comprises an ALP operon from a prokaryotic mobile genetic element. In some embodiments, the ALP has at least 90% identity to a polypeptide sequence selected from the group consisting of SEQ ID NOs:1-409. In some embodiments, the ALP has at least 95%, 96%, 97%, 98%, or 99% identity to a polypeptide sequence selected from the group consisting of SEQ ID NOs:1-409. In some embodiments, the ALP further comprises a polypeptide sequence having at least 90% identity to SEQ ID NO:411.

In some embodiments, the vector encodes an ALP7 stability system comprising an ALP7. In some embodiments, the ALP7 has at least 90% identity to a polypeptide sequence selected from the group consisting of SEQ ID NOs:1-14, or at least 90% identity to the polypeptide sequence of SEQ ID NO:1. In some embodiments, the ALP has at least 95%, 96%, 97%, 98%, or 99% identity to a polypeptide sequence selected from the group consisting of SEQ ID NOs:1-14. In some embodiments, the ALP is selected from the group consisting of SEQ ID NOs: 1-14. In some embodiments, the ALP In some embodiments, the ALP further comprises a polypeptide sequence having at least 90% identity to SEQ ID NO:411. In some embodiments, the vector comprises the polynucleotide sequence of SEQ ID NO:410. In some embodiments, the ALP comprises: D at the residue corresponding to human beta actin residue 11, G at the residue corresponding to human beta actin residue 13, E or Q at the residue corresponding to human beta actin residue 137, D at the residue corresponding to human beta actin residue 154, and G at the residue corresponding to human beta actin residue 156, when optimally aligned with the polypeptide sequence of human beta actin.

In some embodiments, the vector further comprises a polynucleotide encoding a heterologous polypeptide. In some embodiments, the heterologous polypeptide is a commercially important product, e.g., a cellulase, an enzyme, a drug, or a molecular biology tool. In some embodiments, the heterologous polypeptide is comK. One of skill will recognize that more than one coding sequence can be added to the vector, so that multiple heterologous polypeptides are produced. For example, in some embodiments, the vector comprises a coding sequence for each of the com protein components. In some embodiments, the vector comprises comK and an additional heterologous polypeptide. In some embodiments, the polynucleotide encoding the heterolgous polypeptide is included on a different expression vector than the ALP coding sequence.

In some embodiments, the invention provides an isolated bacteria comprising the stability system as described herein. In some embodiments, the isolated bacteria includes a plasmid expression vector that encodes an ALP as described above, e.g., comprising a polypeptide having at least 90% identity to a sequence selected from the group consisting of SEQ ID NOs:1-409. The bacteria can be from any species or strain, e.g., *Bacillus* or *Escherichia*. Exemplary strains of *Bacillus* include *B. subtilis*, *B. megaterium*, *B. amyloliquefaceins*, *B. thuringiensis*, *B. licheniformis*, *B. sphericus*, *B. anthracis*, *B. cereus* and all other related *Bacillus* species.

In some embodiments, the invention provides methods for stable expression of a heterologous polypeptide using a stability system as described herein. In some embodiments, the method comprises introducing an expression vector encoding an ALP, e.g., an ALP7, and a heterologous polypeptide into a bacterial cell, thereby stably expressing the heterologous polypeptide. In some embodiments, the coding sequence for the heterologous polypeptide is included on a separate expression vector than the coding sequence for the ALP. In some embodiments, the heterologous polypeptide is expressed for at least 5, 10, 15, 20, 25, 30, 35, 40, 50, or more generations (i.e., cell divisions) of bacteria. In some embodiments, the expression vector encoding the heterologous polypeptide is maintained for at least 5, 10, 15, 20, 25, 30, 35, 40, 50, or more generations of bacteria. In some embodiments, expression of the heterologous polypeptide is maintained for a longer period of time (e.g., at least 5-, 10-, 15-, 20-, or 50-fold longer) than in bacteria lacking the stability system.

In some embodiments, the invention provides a method for limited expression of a heterologous polypeptide. In some embodiments, the method comprises introducing a vector encoding an ALP7 and a heterologous polypeptide into a bacterial cell, wherein the ALP7 has a substitution at a position corresponding to residue 218 of SEQ ID NO:1, when the ALP7 is optimally aligned to the polypeptide sequence of SEQ ID NO:1. In some embodiments, the method comprises introducing a vector encoding an ALP7 and a heterologous polypeptide into a bacterial cell, wherein the ALP7 has a substitution at a position corresponding to residue 219 of SEQ ID NO:1, when the ALP7 is optimally aligned to the polypeptide sequence of SEQ ID NO:1. In some embodiments, the heterologous polypeptide is comK. In some embodiments, the vector further comprises a mobilization region comprising an origin of transfer.

In some embodiments, the invention provides an isolated plasmid expression vector for conferring competence on a bacterial cell that is otherwise resistant to transformation with exogenous DNA or RNA, i.e., a competence vector. In some embodiments, the competence vector comprises a stability system as described herein, a polynucleotide encoding comK, and a mobilization region comprising an origin of transfer. The comK can be derived from any bacterial species or strain. In some embodiments, the comK is from a *Bacillus* strain. In some embodiments, the invention provides a polynucleotide sequence encoding an ALP, a polynucleotide encoding comK, and mobilization region comprising an origin of transfer. In some embodiments, the ALP is an ALP7. In some embodiments, the plasmid expression vector further comprises a polynucleotide encoding an additional heterologous polypeptide, e.g., a commercially valuable polypeptide or a com protein family member. In some embodiments, the competence vector confers increased competence on a bacteria compared to bacteria lacking the competence vector. In some embodiments, bacteria comprising the competence vector take up at least 5, 10, 20, 30, 40, 50, 100, 200, 400, 500, 1000, or more times as much exogenous DNA than bacteria lacking the vector. Competence can be measured by determining the number of colonies formed under selective conditions that rely on expression of the exogenous DNA, as will be understood by one of skill in the art.

The invention further provides methods for conferring competence on a bacteria, i.e., rendering bacteria competent. In some embodiments, bacteria lacking the competence system described herein are untransformable, or resistant to uptake of exogenous DNA. In some embodiments, the method comprises introducing a plasmid expression vector encoding a stability system as described herein, a polynucleotide encoding comK, and mobilization region comprising an origin of transfer (i.e., a competence vector). In some embodiments, the introducing comprises conjugation. In some embodiments, the stability system comprises an ALP, e.g., an ALP7. In some embodiments, the method comprises (i) introducing an isolated plasmid expression vector comprising a polynucleotide encoding comK and mobilization region comprising an origin of transfer and (ii) introducing an isolated plasmid expression vector comprising a polynucleotide encoding a prokaryote derived ALP having at least 90% identity to a polypeptide sequence selected from the group consisting of SEQ ID NOs:1-409. The steps can be in any order or simultaneous. In some embodiments, the introducing in step (i) is accomplished using conjugation. In some embodiments, the method further comprises introducing an additional plasmid expression vector comprising a polynucleotide encoding a heterologous polypeptide. In some embodiments, the coding sequence for the heterologous polypeptide is included on the plasmid expression vector of part (i). In some embodiments, the coding sequence for the heterologous polypeptide is included on the plasmid expression vector of part (ii). In some embodiments, the ALP confers limited stability, e.g., so that the bacteria are only competent for a limited time.

One of skill will understand that the stability system and competence system of the invention can be used alone or in any combination, on the same vector, or on different vectors. The stability system and/or the competence system can be used to express a desired heterologous protein in bacterial strains that are otherwise not amenable to stable expression of heterologous proteins.

BRIEF DESCRIPTION OF THE DRAWINGS

FIG. 1 illustrates the plasmid constructs used. The pAID3129 plasmid comprises the ALP7 stability system, whereas the pAID3171 plasmid does not. The panel on the right shows that the pAID3129 plasmid is maintained over more than 30 generations of B. subtilis, whereas the pAID3171 plasmid is lost.

FIG. 2. Phylogenetic analysis identifies more than 35 families of bacterial actins. (A) Phlyogenetic tree of the bacterial actins-like proteins (Alps). Protein sequences were derived from the BLAST search series as described in the text and in the Examples. The tree was generated by the neighbor-joining method, and bootstrap values corresponding to confidence levels are indicated for selected branches. Color and number assignments for each family are arbitrary and do not signify relatedness. The five previously characterized families are indicated, as are representatives of three new families: Alp6A, previously designated as GP207 of *Bacillus thuringiensis* phage 0305φ8-36 (Thomas et al., *Virology* 368:405-421 (2007)); Alp7A, previously designated as OrfB of *Bacillus subtilis* natto plasmid pLS20 (Meijer et al., *Nucleic Acids Res* 23:3214-3223 (1995)); Alp8A, previously designated as Orf250 of *Proteus vulgaris* plasmid Rts1 (Murata et al., *J Bacteriol* 184:3194-3202 (2002)). (B) Alignment of the PHOSPHATE 1, CONNECT 1 and PHOSPHATE 2 regions (as per Bork et al., *Proc Natl Acad Sci USA* 89:7290-7294 (1992)) of human beta-actin (SEQ ID NOs:412-414) and representatives of the eight families: *B. subtilis* MreB (SEQ ID NOs:415-417) *B. subtilis* FtsA (SEQ ID NOs:421-423), *E. coli* plasmid R1 ParM (SEQ ID NOs:418-420), *Magnetospirullum gryphiswaldense* MamK (SEQ ID NOs:424-426), *B. subtilis* natto plasmid pLS32 AlfA (SEQ ID NOs:427-429), Alp 6A (SEQ ID NOs:430-432) , Alp7A (SEQ ID NOs:433-435), Alp8A (SEQ ID NOs:436-438). Conserved residues correspond to actin D11, G13, Q137, D154, and G156. (C-F) Fluorescence microscopy images of (C) pP$_{xyl}$alp6A-gfp/DH5α, (D) pP$_{xyl}$alp7A-gfp/MG1655, (E) pP$_{xyl}$alp7A/MG1655, and (F) pP$_{trc a}$lp8A-gfp/TOP10; the promoter is not the true Ptrc promoter but the variant that is present in plasmid pDSW210 (Weiss et al., *J. Bacteriol.* 181:508-520 (1999)). Scale bar (F) equals 1 μm; all images are at the same scale.

FIG. 9 lists the primer sequences (SEQ ID NOs:439-477) used in cloning and characterizing the ALP sequences of the invention.

FIG. 10. (A) A mutation in the alp7A gene in which aspartic acid (D) at position 218 is replaced with asparagine (N) renders the plasmid unstable. Cultures were grown for approximately 30 generations without antibiotics and the percentage of cells containing plasmid was determined. (B) A mutation in the alp7A gene in which the aspartic acid (D) at position 219 is replaced with asparagine (N) reduces plasmid stability. Cultures were grown for approximately 30 generations without antibiotics and the percentage of cells containing the plasmid was determined.

DETAILED DESCRIPTION OF THE INVENTION

I. Introduction to the Invention

Figure 3:
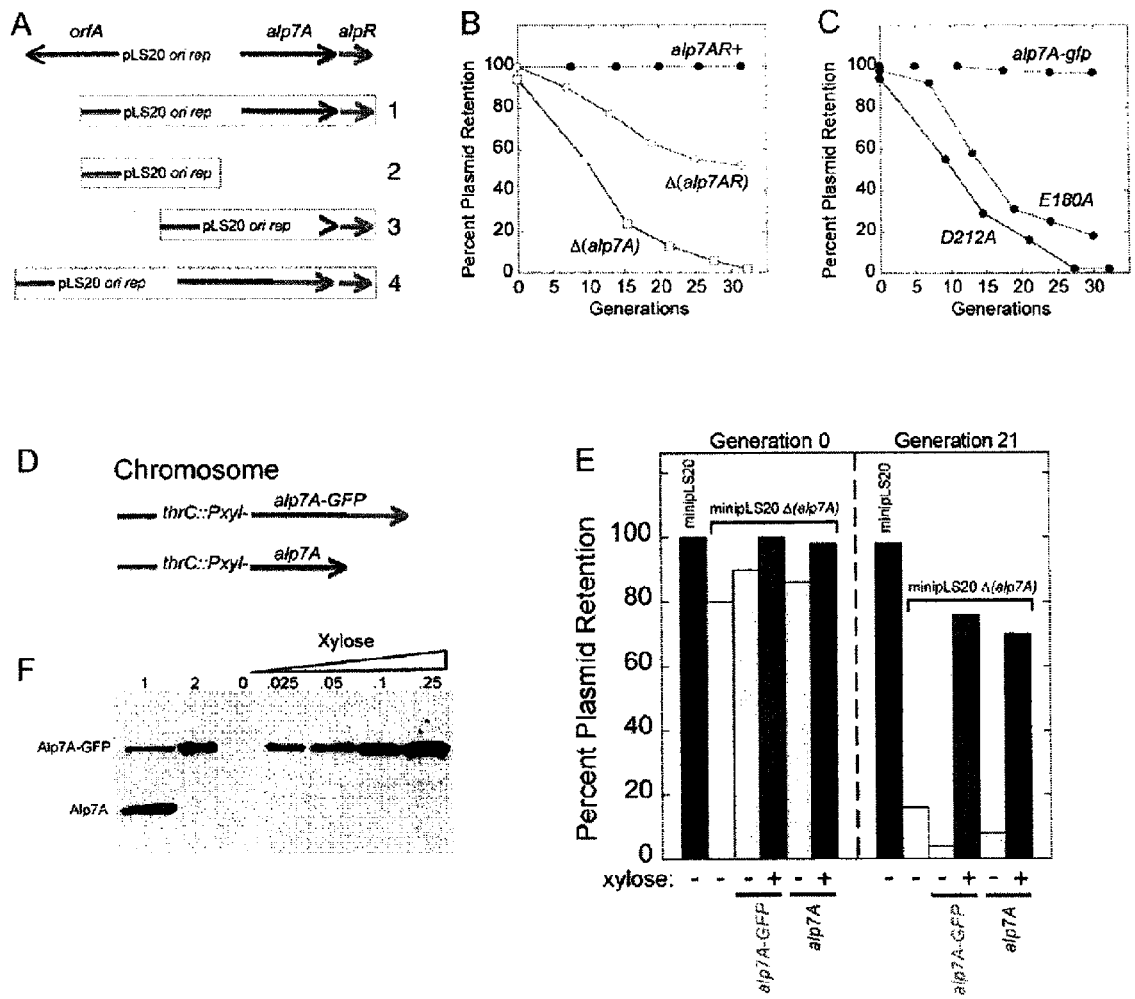
FIG. 3. Alp7A is required for plasmid stability and Alp7A-GFP is functional as well. (A) Plasmid derivatives of the alp7AR region of *B. subtilis* natto plasmid pLS20. The uppermost schematic depicts the alp7AR operon, the divergently transcribed orfA gene, and the intervening origin of replication. The insert in (1) mini-pLS20: the entire alp7AR operon is included as is a portion of orfA containing a putative replication terminator and decatenation site (Meijer, W. J. et al., *Nucleic Acids Res* 23:3214-3223 (1995)); (2) mini-pLS20Δ(alp7AR), containing only the origin of replication; (3) mini-pLS20Δ(alp7A): as mini-pLS20, but alp7A is replaced by an in-frame deletion of the gene; (4) mini-pLS20alp7A-gfp: as mini-pLS20, but alp7A is replaced by alp7A-gfp; the sequence that is immediately upstream of alp7R in pLS20 is included so as to reproduce its native translational context. (B and C) Plasmid retention in logarithmic phase cultures in the absence of antibiotic selection: (B) mini-pLS20 (black), mini-pLS20Δ(alp7AR) (red), mini-pLS20Δ(alp7A) (blue); (C) mini-pLS20alp7A-gfp (green), mini-pLS20alp7A(D212A) (blue), mini-pLS20alp7A (E180A) (red). (D) Chromosomal constructs for plasmid complementation experiment in Panel E: P$_{xyl}$alp7A-gfp or P$_{xyl}$alp7A were integrated into the chromosome of *B. subtilis* strain PY79 at thrC. (E) Restoration of plasmid stability to mini-pLS20Δ(alp7A) by expression of Alp7A or Alp7A-GFP from inducible chromosomal constructs (Panel D). Strains were grown in the presence or absence of 0.25% xylose for 21 generations. (F) Immunoblot of PY79 transformants containing (lane 1) pLS20catalp7A::pMUTINalp7A-gfp; (lane 2) mini-pLS20alp7A-gfp; (lanes 3-7) xylose induction profile of Alp7A-GFP produced from the chromosome in mini-pLS20Δ(alp7A)/PY79 thrC::xylR$^+$P$_{xylA}$alp7A-gfp. The two panels are derived from a single filter that was probed with anti-Alp7A antisera.

The present invention provides for the first time a single expression vector that is stably transmitted, i.e., maintained through multiple successive generations, in several different species of bacteria. The invention thus provides a valuable tool for protein production, including industrial applications that require reliable, high levels of expression. The inventors have also discovered methods and compositions that allow promiscuous transmission into bacterial species that are otherwise resistant to transformation. The compositions of the invention can also be manipulated so that stable transmission is "crippled" or reduced, and the expression vector is not maintained in the bacteria beyond one or a few generations.

The inventors have conducted a phylogenetic bioinformatic search and uncovered more than 35 highly divergent families of actin-like proteins (ALPs) in bacteria. The sequences discovered were not previously recognized as related to actin, and many were not even recognized as coding sequences. The genes are found primarily on phage genomes, on plasmids, and on integrating conjugative elements, and are involved in a variety of functions. The ALPs share the actin function of forming filaments in the cell.

One of these proteins, ALP7, is described herein in detail. ALP7A forms filaments with dynamic properties, a process aided by other elements from the plasmid on which it is encoded. The filaments of ALP7A, a plasmid partitioning protein and one of the most divergent of the ALPs, display dynamic instability and also treadmill. The other elements from the plasmid aid to assemble ALP7A into dynamic polymers in the cell. ALP7 family members share plasmid partitioning activity. Treadmillling is a behavior associated with eukaryotic actin and has also been reported in the C. crescentus MreB. Dynamic instability is a fundamental property of the bacterial actin ParM.

Not all of the Alps are involved in plasmid partitioning. Alp8A is encoded on a plasmid but is not required for its stability. Other Alp8 family members are encoded on integrative conjugative elements that do not replicate autonomously, and so would not require a partitioning machinery.

The findings disclosed herein indicate that the ALPs are actin relatives. That the proteins characterized thus far give

II. Definitions

As used herein, a "stability system" refers to the protein components required to confer stability on a mobile genetic element (e.g., plasmids, transposons, integrating conjugative elements, phage) so that the element is maintained through multiple generations (cell divisions) in a prokaryotic organism. A stability system can also refer to the expression cassette or expression vector that encodes these protein components. The stability system is capable of forming filaments (e.g., polymerization activity) and associating with mobile genetic elements (e.g., DNA binding activity). The stability system comprises a prokaryote-derived actin-like protein (ALP) as disclosed herein, and polypeptide sequences with substantial identity to these sequences. The stability system can be further designated according to the type of ALP that is included, e.g., an ALP6 stability system, or an ALP7 stability system, which will be understood to include an ALP6 or ALP7.

"Prokaryote-derived actin like proteins (ALPs)" include proteins comprising the polypeptide sequences described herein (SEQ ID NOs:1-409), as well as sequences with substantial identity to those sequences (i.e., a sequence has at least 30% identity, e.g., 35%, 45%, 50%, 60%, 65%, 75%, 85%, 90%, 91%, 92%, 93, 94%, 95%, 96%, 97%, 98%, 99%, or 100% identity, to a reference sequence, e.g., any one of SEQ ID NOs: 1-409, e.g., or any one of SEQ ID NO:1-14), that have at least one actin-like activity. Substantial identity is determined by comparison and alignment for maximum correspondence over a comparison window, or designated region as measured using one of the following sequence comparison algorithms or by manual alignment and visual inspection. Such sequences are said to be "substantially identical." ALP sequences found in bacteria are highly divergent, and proteins are grouped into different Alp families with a 30% cutoff. For example, members of the Alp7 family share only 35% identity, yet share the same filament-forming activity. This is very different from eukaryotic actin, which is highly conserved The polynucleotide sequences that encode ALP polypeptides are included in the invention, as are polynucleotide sequences that are substantially identical to a polynucleotide sequence encoding a polypeptide sequence disclosed herein.

Actin-like activities include polymerization and filament formation, DNA binding, treadmilling, hydrolysis of ATP and/or GTP, interaction with cytoskeletal proteins, interaction with cell membranes, determination of cell shape, effecting cell motility, etc.

Human beta actin is a known 375 amino acid cytoskeletal protein that forms part of the contractile apparatus. The polypeptide sequence can be found under accession number P60709.1.

The term "nucleic acid" or "polynucleotide" refers to deoxyribonucleic acids (DNA) or ribonucleic acids (RNA) and polymers thereof in either single- or double-stranded form. Unless specifically limited, the term encompasses nucleic acids containing known analogs of natural nucleotides that have similar binding properties as the reference nucleic acid. Unless otherwise indicated, a particular nucleic acid sequence also implicitly encompasses conservatively modified variants thereof (e.g., degenerate codon substitutions), alleles, orthologs, single nucleotide polymorphisms (SNPs), and complementary sequences as well as the sequence explicitly indicated. Specifically, degenerate codon substitutions may be achieved by generating sequences in which the third position of one or more selected (or all) codons is substituted with mixed-base and/or deoxyinosine residues (Batzer et al., *Nucleic Acid Res.* 19:5081 (1991); Ohtsuka et al., *J. Biol. Chem.* 260:2605-2608 (1985); and Rossolini et al., *Mol. Cell. Probes* 8:91-98 (1994)).

The phrase "nucleic acid sequence encoding" refers to a nucleic acid which directs the expression of a specific protein or peptide. The nucleic acid sequences include both the DNA strand sequence that is transcribed into RNA and the RNA sequence that is translated into protein. The nucleic acid sequences include both the full length nucleic acid sequences as well as non-full length sequences derived from the full length sequences. It should be further understood that the sequence includes the degenerate codons of the native sequence or sequences which may be introduced to provide codon preference in a specific host cell.

"Conservatively modified variants" applies to both amino acid and nucleic acid sequences. With respect to particular nucleic acid sequences, "conservatively modified variants" refers to those nucleic acids that encode identical or essentially identical amino acid sequences, or where the nucleic acid does not encode an amino acid sequence, to essentially identical sequences. Because of the degeneracy of the genetic code, a large number of functionally identical nucleic acids encode any given protein. For instance, the codons GCA, GCC, GCG and GCU all encode the amino acid alanine. Thus, at every position where an alanine is specified by a codon, the codon can be altered to any of the corresponding codons described without altering the encoded polypeptide. Such nucleic acid variations are "silent variations," which are one species of conservatively modified variations. Every nucleic acid sequence herein that encodes a polypeptide also describes every possible silent variation of the nucleic acid. One of skill will recognize that each codon in a nucleic acid (except AUG, which is ordinarily the only codon for methionine, and TGG, which is ordinarily the only codon for tryptophan) can be modified to yield a functionally identical molecule. Accordingly, each silent variation of a nucleic acid that encodes a polypeptide is implicit in each described sequence.

As to amino acid sequences, one of skill will recognize that individual substitutions, deletions or additions to a nucleic acid, peptide, polypeptide, or protein sequence which alters, adds or deletes a single amino acid or a small percentage of amino acids in the encoded sequence is a "conservatively modified variant" where the alteration results in the substitution of an amino acid with a chemically similar amino acid. Conservative substitution tables providing functionally similar amino acids are well known in the art. Such conservatively modified variants are in addition to and do not exclude polymorphic variants, interspecies homologs, and alleles of the invention.

The following eight groups each contain amino acids that are conservative substitutions for one another:
1) Alanine (A), Glycine (G);
2) Aspartic acid (D), Glutamic acid (E);
3) Asparagine (N), Glutamine (Q);
4) Arginine (R), Lysine (K);
5) Isoleucine (I), Leucine (L), Methionine (M), Valine (V);
6) Phenylalanine (F), Tyrosine (Y), Tryptophan (W);
7) Serine (S), Threonine (T); and
8) Cysteine (C), Methionine (M)
(see, e.g., Creighton, Proteins, W. H. Freeman and Co., N.Y. (1984)).

A polynucleotide sequence is "heterologous to" a second polynucleotide sequence if it originates from a foreign species, or, if from the same species, is modified by human action from its original form. For example, a promoter operably linked to a heterologous coding sequence refers to a coding sequence from a species different from that from which the promoter was derived, or, if from the same species, a coding sequence which is different from any naturally occurring allelic variants.

The term "recombinant" when used with reference, e.g., to a cell, or nucleic acid, protein, or vector, indicates that the cell, nucleic acid, protein or vector, has been modified by the introduction of a heterologous nucleic acid or protein or the alteration of a native nucleic acid or protein, or that the cell is derived from a cell so modified. Thus, e.g., recombinant cells express genes that are not found within the native (non-recombinant) form of the cell or express native genes that are otherwise abnormally expressed, under expressed or not expressed at all. By the term "recombinant nucleic acid" herein is meant nucleic acid, originally formed in vitro, in general, by the manipulation of nucleic acid, e.g., using polymerases and endonucleases. In this manner, operably linkage of different sequences is achieved. Thus an isolated nucleic acid, in a linear form, or an expression vector formed in vitro by ligating DNA molecules that are not normally joined, are both considered recombinant for the purposes of this invention. It is understood that once a recombinant nucleic acid is made and reintroduced into a host cell or organism, it will replicate non-recombinantly, i.e., using the in vivo cellular machinery of the host cell rather than in vitro manipulations; however, such nucleic acids, once produced recombinantly, although subsequently replicated non-recombinantly, are still considered recombinant for the purposes of the invention. Similarly, a "recombinant protein" is a protein made using recombinant techniques, i.e., through the expression of a recombinant nucleic acid as depicted above.

A "promoter" is defined as an array of nucleic acid control sequences that direct transcription of a nucleic acid. As used herein, a promoter includes necessary nucleic acid sequences near the start site of transcription, such as, in the case of a polymerase II type promoter, a TATA element. A promoter also optionally includes distal enhancer or repressor elements, which can be located as much as several thousand base pairs from the start site of transcription. A "constitutive" promoter is a promoter that is active under most environmental and developmental conditions. An "inducible" promoter is a promoter that is active under environmental or developmental regulation. The term "operably linked" refers to a functional linkage between a nucleic acid expression control sequence (such as a promoter, or array of transcription factor binding sites) and a second nucleic acid sequence, wherein the expression control sequence directs transcription of the nucleic acid corresponding to the second sequence.

An "expression vector" is a nucleic acid construct, generated recombinantly or synthetically, with a series of specified nucleic acid elements that permit transcription of a particular nucleic acid in a host cell. The expression vector can be part of a plasmid, virus, or nucleic acid fragment. Typically, the expression vector includes a nucleic acid to be transcribed operably linked to a promoter.

The term "operably linked" refers to a functional linkage between a nucleic acid expression control sequence (such as a promoter, or array of transcription factor binding sites) and a second nucleic acid sequence, wherein the expression control sequence directs transcription of the nucleic acid corresponding to the second sequence.

Two nucleic acid or polypeptide sequences are said to be "identical" if the sequence of nucleotides or amino acid residues, respectively, in the two sequences is the same when aligned for maximum correspondence as described below.

The term "complementary to" is used herein to mean that the sequence is complementary to all or a portion of a reference polynucleotide sequence.

Optimal alignment of sequences for comparison may be conducted by the local homology algorithm of Smith and Waterman *Add. APL. Math.* 2:482 (1981), by the homology alignment algorithm of Needle man and Wunsch *J. Mol. Biol.* 48:443 (1970), by the search for similarity method of Pearson and Lipman *Proc. Natl. Acad. Sci.* (*U.S.A.*) 85: 2444 (1988), by computerized implementations of these algorithms (GAP, BESTFIT, BLAST, FASTA, and TFASTA in the Wisconsin Genetics Software Package, Genetics Computer Group (GCG), 575 Science Dr., Madison, Wis.), or by inspection. Optimal alignment generally refers to the alignment that results in the highest percent homology. This can result in gaps in one sequence, or alignment with a conservative or similar amino acid instead of a perfect match. The term is understood generally in the art.

"Percentage of sequence identity" is determined by comparing two optimally aligned sequences over a comparison window, wherein the portion of the polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity.

The term "substantial identity" of polypeptide or polynucleotide sequences refers to a sequence with at least 30% sequence identity. Alternatively, percent identity can be any integer from 65% to 100%. In some embodiments, the sequences share at least: 65%, 70%, 75%, 80%, 85%, 90%, 95%, 98%, or 99%, compared to a reference sequence using the programs described herein; preferably BLAST using standard parameters, as described below. Accordingly, ALP sequences of the invention include polypeptide sequences that have substantial identity to the sequences disclosed herein. The ALP sequences of the invention also include polynucleotide sequences that are substantially identical to polynucleotides that encode the polypeptide sequences disclosed herein. One of skill will recognize that these values can be appropriately adjusted to determine corresponding identity of proteins encoded by two nucleotide sequences by taking into account codon degeneracy, amino acid similarity, reading frame positioning and the like.

Polypeptides which are "substantially similar" share sequences as noted above except that residue positions which are not identical may differ by conservative amino acid changes. Conservative amino acid substitutions refer to the interchangeability of residues having similar side chains. For example, a group of amino acids having aliphatic side chains is glycine, alanine, valine, leucine, and isoleucine; a group of amino acids having aliphatic-hydroxyl side chains is serine and threonine; a group of amino acids having amide-containing side chains is asparagine and glutamine; a group of amino acids having aromatic side chains is phenylalanine, tyrosine, and tryptophan; a group of amino acids having basic side chains is lysine, arginine, and histidine; and a group of amino acids having sulfur-containing side chains is cysteine and methionine. Preferred conservative amino acids substitution groups are: valine-leucine-isoleucine, phenylalanine-tyrosine, lysine-arginine, alanine-valine, aspartic acid-glutamic acid, and asparagine-glutamine.

III. General Recombinant Methods

The recombinant methodology used in the invention is routine in the field of recombinant genetics. Basic texts disclosing the general methods include Sambrook & Russell, *Molecular Cloning, A Laboratory Manual* (3rd ed. 2001); Kriegler, *Gene Transfer and Expression: A Laboratory Manual* (1990); and *Current Protocols in Molecular Biology* (Ausubel et al., eds., 1994)).

To obtain high level protein expression, one typically subclones a nucleic acid sequence encoding the protein of into an expression vector that contains a promoter, typically a heterologous promoter, to direct transcription, a transcription/translation terminator, and a ribosome binding site for translational initiation. Suitable promoters are well known in the art and described, e.g., in Sambrook & Russell and Ausubel et al. Bacterial expression systems for expressing the protein are available in, e.g., *E. coli, Bacillus* sp., and *Salmonella* (Palva et al., *Gene* 22:229-235 (1983); Mosbach et al., *Nature* 302: 543-545 (1983)). Tags can also be added to recombinant proteins to provide convenient methods of isolation, e.g., c-myc, biotin, poly-His, etc. Kits for such expression systems are commercially available.

IV. Utilities

The ALPs of the invention can be used in stability systems to confer stability on extrachromosomal genetic material (i.e., mobile genetic elements, such as plasmids). Stability systems can thus be used in combination with expression vectors encoding heterologous proteins for reliable, continued expression of a desired protein product. The stability system can be encoded on the same expression vector or a different expression vector than the heterologous protein. In addition, more than one heterologous protein can be expressed.

A particular application of the stability system includes conferring competence on otherwise genetically incompetent or resistant bacterial cells. In this case, the comK gene is expressed in combination with the stability system, either on the same expression vector or a different expression vector. The cells will remain competent for as long as the stability system is active in the cell, and additional expression vectors can be introduced.

An additional application for Alps is for creation of synthetic organisms. Synthetic organisms can be used for a variety of purposes, including industrial enzyme production, biofuel and electrical energy production, vaccine development, and novel anticancer therapies. One key to the creation of these novel forms of life is the development of synthetic, self replicating DNA molecules capable of being segregated into daughter cells. The stability system of the invention can be used to provide a segregation system for any self replicating DNA molecule, including synthetic genomes. The Alps described herein self-assemble into force-generating molecular machines capable of a variety of vital cellular activities, including separation of DNA molecules for division. The ALPs of the invention thus represent a large and diverse set of molecular tools—"off the shelf bioparts"—that can be used for synthetic life.

V. EXAMPLES

Summary of the Results

We have identified 35 distinct prokaryotic protein families that share actin activities. These are called actin like proteins (ALPs). Despite the very tenuous connection of these sequences to eukaryotic actin, we further characterized a few of these proteins for confirmation. One particularly divergent member, ALP7A, formed filaments within the cell and these filaments exhibited two dynamic behaviors, dynamic insta-bility and treadmilling. Additional sequence from the ALP7 operon, including 165 bp upstream of the ALP7A initiation site and ALP7R, was found to improve filament formation by ALP7A.

ALP7A-GFP fusion protein retained the function of ALP7A and could be used interchangeably. We thus correlated ALP7A function with its behavior in the cell. In particular, we found that mutations in two amino acids that disrupted Alp7A polymerization dynamics. The D212A mutation, which abolished filament formation, was indistinguishable from a null mutation in a plasmid stability assay. The E180A mutation, which permitted filaments to form but eliminated their dynamic properties, was almost as crippling. Moreover, we have discovered amino acid residues that can moderate the stability conferred by ALP7A. In particular, substitution of D218 results in rapid loss of the plasmid, while substitution of D219 results in a slower loss of the plasmid.

Finally, we have developed an expression construct that takes advantage of the stability system of the invention. Using the ALP7 stability construct, we added a sequence encoding comK, which is part of the com family of proteins that confer genetic competence on bacteria. The competence (or comK) system is stably passed on through multiple generations, and allows the bacterial cells to be transformed. One of skill will recognize that the competence system can be used with the modulated stability system to confer limited competence. Moreover, for bacterial strains that do not include the full complement of com genes, these can be additionally included in the cells.

Example 1

FIG. 1 illustrates the plasmid constructs used. The pAID3129 plasmid comprises the orfB stability system (orfB and orfC), whereas the pAID3171 plasmid does not. OrfB in pAID3129 comprises the nucleotide sequence encoding orfB of pLS20, as described herein. OrfC encodes a DNA binding protein. These plasmids were transfected into a *Bacillus* strain and tracked over more than 30 generations. As shown in FIG. 1, the pAID3129 plasmid was maintained in 100% of the bacteria. The pAID3171 plasmid was lost, with only about 50% of the cells carrying the vector after 30 generations.

Example 2

Experimental Procedures

Phylogenetic Analysis

The AlfA sequence was used to begin the BLAST iteration series; the same sequences were retrieved if other bacterial actins were used, though not necessarily in the same order.

Sequences were aligned using TCoffee and ClustalW and phylogenetic trees were constructed with ClustalW. A bootstrap consensus tree of 100 trees is shown. The 100 trees were generated by resampling the data set and creating a distance matrix using a PAM matrix to assign weights to amino acid substitutions. Neighbor joining was used to assemble the 100 distance matrices into 100 trees. Similar trees were obtained regardless of the method used. The cutoff for assignment to a family was 30% sequence identity.

Molecular Biology

Standard techniques of molecular biology were used. Genomic DNA was purified from *Bacillus* with a modification of a protocol developed for Gram-negative bacteria (Neumann et al., *Trends Genet.* 8:332-333 (1992)). Other nucleic acid purifications were done with commercial kits manufactured by Qiagen or Invitrogen. Oligonucleotide primers were synthesized by Allele Biotechnology and Pharmaceuticals or by Integrated DNA Technologies. PfuUltra High-Fidelity Polymerase, which was used for nearly all PCR amplifications, from Stratagene. Amplifications were carried out in a Mastercycler EP (Eppendorf). Restriction endonucleases were obtained from New England Biolabs unless otherwise noted. Shrimp alkaline phosphatase was obtained from Roche Diagnostics GmbH, and T4 DNA ligase from New England Biolabs, RNAase was obtained from Qiagen and DNAase from Invitrogen. Other biochemicals and chemicals were obtained from Fisher, VWR, or Sigma. Plasmids were introduced into *E. coli* strains DH5α, MG1655, or TOP10 by electroporation with a Gene Pulser Xcell (Biorad) or by transformation of chemically competent cells (Hanahan *DNA Cloning: A Practical Approach*, (ed. D. M. Glover), pp. 109-135. IRL Press, Oxford, UK (1985)). DNA sequencing was performed by Eton Bioscience or by Genewiz. Primer sequences are listed in FIG. 9.

Sequencing of the alp7AR Operon

Semidegenerate PCR was used to amplify the latter part of the alp7A gene and the remainder of the alp7AR operon (Jacobs et al., *Proc. Natl. Acad. Sci. USA* 100:14339-14344 (2003)). Amplicons were cloned into the pCR2.1-TOPO vector (Invitrogen) and submitted for sequencing.

Plasmids and Plasmid Constructions

Alp6A

*Bacillus thuringiensis* phage 0305φ8-36 DNA was obtained from Stephen Hardies and Julie Thomas at the University of Texas Health Science Center, San Antonio, Tex.

Plasmid pPAU12 (pP$_{xyl}$alp6A-gfp) was constructed from plasmid pPAU11, which contains a fusion of gfp to alp6A. pPAU11 was constructed by PCR amplification of *Bacillus thuringiensis* phage 0305φ8-36 DNA (Thomas et al., *Virology* 368:405-421 (2007)) with oligonucleotide primers P1 and P2, restriction of the amplicon with KpnI and ClaI, and ligation of the product to plasmid pMUTIN-GFP+ (Kaltwasser, M. et al., *Appl. Environ. Microbiol.* 68:2624-2628 (2002)) restricted with KpnI and ClaI. The cloned segment includes 41 bp upstream of the alp6A initiation codon. pPAU11 DNA was amplified with oligonucleotide primers P3 and P4, the amplicon was restricted with KpnI, and ligated to pWH1520 (Rygus et al., *Appl. Microbiol. Biotechnol.* 35:594-599 (1991)) restricted with KpnI.

Alp7A

Plasmid pAID3107 (pP$_{xyl}$alp7A-gfp) was constructed from plasmid pAID3068, which contains a fusion of gfp to ALP7A from pLS20 *Bacillus subtilis*

(SEQ ID NO: 1)

MNISRMNVDFGNSMYMNLIDGYFFELPTNVVEISKEAAEGKFTSIVEDPADLKDRLLVS

TVIDETERYFLVGELAEPEVLGNQHIKKLHNKVESHIPYVTFLAATAYYQALKGKREDN

EVTIEYFQTMLPIWLLKKLDKFSEMQKRMASKFLGTHQVKVLTLGLEKELTIKVEDAAC

RIESEVARWAIKKNFDLEDKDYAEQFKNYDVVFCDLGGGTDDLVLLPAGLKPPKSRDSF

VSNTEAPFLAHLEKLRKEKLLEHFDSVRELEKFIYSNIGKTKMERRDGNTGQKFDLTDII

KKSLKEYTEIKIAQAENTFPAPKDKVYKYLYFGGVGEVLEESISVVTEERYGRDISESNHI

VAEDARLLNLYGLEVLSRAEQVKKQANEKEAQSI

ALP7A gene (SEQ ID NO: 410)

Atgaatatttctcgtatgaacgtggactttggaaacagtatgtacatgaatttaattgatggttattttttgaattgcctacaaatgtagtaga gatatctaaagaagctgctgaaggaaaatttacgagtatcgttgaagatccggcagatttaaaggaccggttattagtttctacagttattgatg aaacagagagatattttctagttggtgaacttgctgaaccagaagtgttaggcaaccaacacatcaagaagttacataataaagtagagtcacat attccatacgtaacattttagctgcaactgcttattaccaagcgctaaaaggcaaacgtgaagataatgaagttactattgaatactttcaaac aatgctaccaatttggcttcttaaaaaattggataagttcagtgaaatgcagaaaaggatggcatctaaattttgggcactcaccaagtaaagg tgctgacattaggattagaaaaagagcttactataaaagtggaagatgcagcgtgcaggatcgaatctgaagtagcaagatgggcaataaagaa aaactttgacctagaagataaagactatgccgaacaatttaaaaattatgacgtagttttttgtgatttaggtggcggaacagatgatctagtat tactaccagctggattaaaaccgccaaaaagtcgtgattcttttgtttctaataccgaagcaccgttttagcgcacttagaaaaattgagaaaa gaaaaactcctagagcactttgatagcgttagggagcttgaaaagtttatatactcaaatattggaaaaactaagatggaacgaagagacgg gaataccggtcagaaatttgatttaactgatatcatcaaaaaatctcttaaagaatacacagaaatcaaaatagcccaagctgaaatacgttc cctgcaccaaaagataaggtttacaaatacctttattttggcggtgttggcgaggtgcttgaagaatcaattagtgtggttactgaagagata tggccgtgatatttctgaatcaaatcatatagttgctgaggatgcaagactgctcaacttatatggccttgaagttttaagccgcgctgaacaag taaagaaacaggcaaatgaaaaagaggcacaatcaatttag ALP7R from pLS20 *Bacillus subtilis*

(SEQ ID NO: 411)

MGKNKRIPLFNVRTTQMSDEMYDFVLEQISTFSKGKSKGTFREYAFQLIERDMQQQKEE

QQNREKDRHVHDELIAMREEMKKEFRDLRKKIDQGSIYVEHKTADPKSASETIEEGQLIT

EKITGTIEEEYDYDF alp7A. pAID3068 was constructed by PCR amplification of genomic DNA from strain IFO3335 with oligonucleotide primers P7 and P8, restriction of the amplicon with KpnI and ClaI, and ligation of the product to plasmid pMUTIN-GFP+ restricted with KpnI and ClaI. The cloned segment includes 731 bp upstream of the alp7A initiation codon, pAID3068 DNA was amplified with oligonucleotide primers P9 and P10, the amplicon was restricted with KpnI and SphI, and ligated to pWH1520 restricted with KpnI and SphI, to produce pAID3107.

Plasmid pAID3129 (mini-pLS20) was constructed by PCR amplification of genomic DNA from *Bacillus subtilis* natto strain IFO3335 with oligonucleotide primers P11 and P12, restriction of the amplicon with NsiI and NheI, and ligation of the product to plasmid pHW 1520 restricted with NsiI and NheI. The 3501 bp cloned segment contains a fragment of orfA, prematurely terminated at amino acid 141, the pLS20 origin of replication, and the orfBC (alp7AR) operon through its transcription terminator. Plasmid pAID3147 (mini-pLS20Δ(alp7A)) was constructed via a modification of the standard PCR-based site-directed mutagenesis protocol with pAID3129 as template and mutagenic oligonucleotide primers P13 and P14 (Wang et al., *BioTechniques* 26:680-682 (1999)). In pAID3147, alp7A is replaced by an in-frame deletion that consists of an AvrII site flanked by the first four and last five codons of the gene. Plasmid pAID3171 (mini-pLS20Δ(alp7AR)) was constructed by restriction of pAID3129 with NheI, fill-in of the 5' overhang with T4 DNA polymerase, partial digestion with SmaI, and monomolecular ligation of the 8387 bp fragment. pAID3171 contains the prematurely terminated orfA fragment, the origin of replication, and pLS20 sequences through 166 bp upstream of the alp7A initiation codon.

Plasmid pEB416 (mini-pLS20 (lacO)$_x$) was constructed by introducing into pAID3129 a fragment containing a spectinomycin resistance gene flanked by lacO arrays. This fragment was constructed by modifying plasmid pLAU43 (Lau, I. F. et al., *Mol. Microbiol.* 49:731-743 (2003)), which contains arrays of 120 lacO operators on either side of a gene that codes for kanamycin resistance. Plasmid pSE380 (Invitrogen) was restricted with SalI and XbaI, and the 118 amino acid fragment derived from the multiple cloning site was ligated to pLAU43 restricted with SalI and XbaI. The kanamycin resistance gene in the resulting plasmid, pRL153, was then replaced with one for spectinomycin resistance from plasmid pMDS13 (Sharp and Pogliano 2002) by amplification of pMDS13 with primers P15 and P16, restriction of the amplicon with NsiI, and ligation of the product to pRL153 restricted with NsiI. Restriction of the resulting plasmid with BamHI generated the fragment that was ligated to pAID3129 restricted with Bgl II.

Plasmid pAID3205 (pP$_{xylA}$alp7A) was constructed from pAID3107. pAID3107 was restricted with EcoRI in the presence of ethidium bromide, then with EagI, and the two 5' overhangs were filled in with T4 DNA polymerase. Monomolecular ligation of the resulting 9218 bp fragment produced a template for site-directed mutagenesis with oligonucleotide primers P17 and P18, which modified the blunt end junction to match the transcription termination sequences to that of alp7A-gfp in pAID3107.

Plasmid pAID3195 (mini-pLS20alp7A-gfp) was constructed by ligating the 7706 bp BspEI-MluI restriction fragment from pAID3147, the 2631 bp BspEI-SpeI restriction fragment from methylated pAID3068, and the SpeI-MluI restricted amplicon generated by PCR amplification of pAID3147 with oligonucleotide primers P19 and P20. In pAID3147, the Δalp7A in-frame deletion and alp7AR intergenic region is interposed between alp7A-gfp and alp7R in order to place alp7R into its native translational context.

The alp7AR mutations D212A and E180A were constructed via standard PCR-based site-directed mutagenesis (Papworth et al., *Strategies* 8:3-4 (1996)) with template pAID3205 (for D212A) or a smaller variant of pAID3129 (for E180A) with oligonucleotide primers P21 and P22 (D212A) and oligonucleotide primers P23 and P24 (E180A). The mutations were then introduced into pAID3129 and pAID3107 by swapping in a 695 bp AgeI restriction fragment.

Plasmid pAID3118 (pP$_{T7}$His$_6$-alp7A) was constructed by PCR amplification of genomic DNA from strain IFO3335 with oligonucleotide primers P25 and P26, cloning into the pCR-Blunt II-TOPO vector (Invitrogen), restriction of the resulting plasmid with NheI, and ligation of the 1179 bp fragment to plasmid pET-28a(+) (Novagen) restricted with NheI.

Alp8A

Plasmid pEB400 (pP$_{trc}$[Rts1 orf250]-gfp) was constructed by PCR amplification of genomic DNA from *E. coli* strain ER1648 with oligonucleotide primers P27 and P28, restriction of the amplicon with KpnI and PstI, and ligation of the product to pDSW210 (Weiss, D. S. et al., *J. Bacteriol.* 181: 508-520 (1999)) restricted with KpnI and PstI. The promoter in pDSW210 is a variant of the P$_{trc}$ promoter.

Bacterial Strains and Strain Constructions

*Bacillus subtilis* natto strain IFO3335 (BGSC 27E1) (Tanaka et al., *J. Bacteriol.* 131:699-701 (1977)) was obtained from the *Bacillus* Genetic Stock Center at The Ohio State University, Columbus, Ohio. *E. coli* strain ER1648 containing plasmid Rts1 (Murata et al., *J Bacteriol* 184:3194-3202 (2002)) was obtained from Tetsuya Hayashi at the University of Miyazaki, Miyazaki, Japan. *Bacillus subtilis* strains BEST2125 and BEST40401 (Itaya et al., *Biosci. Biotechnol. Biochem.* 70:740-742 (2006)) were obtained form Mitsuhiro Itaya at the Mitsubishi Kagaku Institute of Life Sciences, Tokyo, Japan.

All physiology and microscopy experiments were carried out at 30° C. in *Bacillus subtilis* strain PY79 (Youngman et al., *Plasmid* 12:1-9 (1984)) or in *E. coli* strains DH5α, MG1655, or TOP10 (Invitrogen). Strain JP3100 (pLS20cat/PY79) was constructed by first conjugating plasmid pLS20cat from strain BEST40401 into strain BEST2125, and from the resulting exconjugant into PY79 (Itaya et al., *Biosci. Biotechnol. Biochem.* 70:740-742 (2006)). Strain JP3104 (JP3100 pLS20catalp7A::pAID3068) is an integrant of plasmid pAID3068 into the pLS20cat plasmid resident in JP3100. Strain JP3161 (PY79 thrC::xylR$^+$P$_{xylA}$alp7A-gfp) was constructed by integration into the PY79 chromosome of a segment of plasmid pAID3107 containing the xylR gene and P$_{xylA}$alp7A-gfp. A 3918 bp segment was amplified from pAID3107 with primers P29 and P30, the amplicon was restricted with BglII, and the product was ligated to *B. subtilis* chromosomal integration vector pDG1664 (Guérot-Fleury et al., *Gene* 180:57-61 (1996)) restricted with BamHI, to match the transcriptional orientation of the threonine operon on the vector. The cloned segment was then integrated into the PY79 chromosome at thrC by a double recombination event. The same strategy was used to construct strain JP3206 in which a 3180 segment of plasmid pAID3205 containing the xylR gene and P$_{xylA}$alp7A is integrated into the PY79 chromosome.

Strain EBS1340 (PY79 amyE::P$_{xylA}$[lacI-cfp3A]) was constructed by integrating into the PY79 chromosome a segment from plasmid pEB387, a derivative of the *B. subtilis* chromosomal integration vector pDG1662 (Guérot-Fleury et al., *Gene* 180:57-61 (1996)). pEB387 was constructed from plasmid pMDS78, a derivative of pDG1662 that contains $P_{spoIIR}$gfp, the gfp gene under control of the *B. subtilis* spoIIR promoter (Sharp et al., *Science* 295:137-139 (2002)). The spoIIR promoter region in pMDS78 was replaced with the spoIIE promoter region by PCR amplification of the spoIIE promoter region from PY79 with primers P31 and P32, restriction of the amplicon with BamHI and EcoRI, and ligation of the product to pMDS78 restricted with BamHI and EcoRI. The gfp gene in this intermediate plasmid was then replaced with the cfp3A gene by PCR amplification of the gene from pSCFP3A-C1 (Kremers et al., *Biochemistry* 45:6570-6580 (2006)) with primers P33 and P34, restriction of the amplicon with SpeI and EagI, and ligation of the product to the intermediate plasmid restricted with SpeI and EagI. The lacI fusion to cfp3A was constructed in this second intermediate plasmid. The lacI gene lacking the coding sequence for the last 11 amino acids was amplified from pMUTIN-GFP with primers P35 and P36, the amplicon was restricted with SpeI and BamHI, and the product was ligated to the second intermediate plasmid restricted with SpeI and BamHI. The spoIIE promoter in this plasmid, pEB307, was then replaced with $P_{xyl}$ by PCR amplification of plasmid pEA18 (Quisel et al., *Mol. Cell.* 4:665-672 (1999)) with primers P37 and P38, restriction of the amplicon with BglII and EcoRI, and ligation of the product to pEB307 restricted with BglII and EcoRI. Lastly the ribosome binding site for the lacI-cfp3A fusion in this plasmid, pEB384, was replaced with an optimized version generated by amplification of the fusion from pEB384 with primers P34 and P39, digestion of the amplicon with HindIII, and ligation pEB384 digested with Hind III. P39 introduces the modified ribosome binding site and also appends eight codons (MKNIEKVS; SEQ ID NO:478) to the beginning of the lacI gene. The $P_{xyl}$lacI-cfp3A gene fusion was then integrated onto the PY79 chromosome at amyE by a double recombination event, to produce EBS1340.

All other *Bacillus subtilis* strains were constructed by standard transformation of PY79 or derivatives of PY79 with the plasmids described (Dubnau et al., *J. Mol. Biol.* 56:209-221 (1971)). pLS20 was introduced into strains by conjugation.

Media for strains containing pLS20cat was supplemented with 5 μg/ml chloramphenicol. Media for strains containing derivatives of pWH1520 was supplemented with 100 μg/ml ampicillin or carbenicillin for *E. coli*, or with 10 μg/ml tetracycline for *Bacillus*. Erythromycin was used at 2 μg/ml for *Bacillus*, kanamycin at 50 μg/ml for *E. coli*, and spectinomycin was used at 100 μg/ml for either *Bacillus* or *E. coli*.

Plasmid Stability and Plasmid Stability Complementation Assays

Shake flask cultures in LB medium were inoculated from small starter cultures in LB medium supplemented with 5 μg/ml chloramphenicol or 10 μg/ml tetracycline. Cultures were aerated at 250 RPM and maintained in exponential growth at 30° C. by iterative 1/60 dilution into flasks containing prewarmed medium at early exponential phase ($OD_{600}$=0.1 or 0.2), corresponding to approximately six generations. Growth was taken to the end of 30 generations. At each dilution, samples were plated on nonselective medium, and 100 colonies were tested for retention of antibiotic resistance. Generation times were calculated from each interval and the mode value was applied to the entire growth course. For complementation assays, starter and experimental cultures contained an appropriate amount of xylose or glucose, growth was continued for approximately 20 generations, and platings were done only at t0 and at the end of the experiment.

Antibody Production

Hexahistidine (SEQ ID NO:479) tagged Alp7A was recovered from strain JP3118 as inclusion bodies after a 3 h induction at 30° C. The cells were lysed as described (Derman et al., *EMBO J.* 12: 879-888 (1993)), treated with DNase I (Invitrogen), and the post-lysis pellets containing the inclusion bodies were washed twice with water and then twice with a buffer consisting of 300 mM NaCl, 12.5 mM imidazole, 50 mM $Na_xH_yPO_4$, pH 8.0. The washed pellets were dissolved in the same buffer containing 8 M urea, the solution was centrifuged at 20,000×g for 30 min, and the denatured Alp7A was purified from the supernatant by nickel affinity chromatography as described except that 8 M urea was present throughout (Lim et al., *Proc. Natl. Acad. Sci. USA* 102:17658-17663 (2005)). Fractions containing Alp7A were dialyzed against PBS and the dialyzed protein was used for antibody preparation. Polyclonal antibodies were generated in rabbits by Antibodies Inc.

Immunoblotting

Proteins were electrotransferred from polyacrylamide gels to PVDF membranes, and probed with the polyclonal antiserum raised against Alp7A and an anti-rabbit IgG linked to HRP (GE Healthcare). Immunoblots were developed with the ECL Plus Western Blotting Detection System (GE Healthcare), visualized with a Typhoon 9400 Variable Mode Imager (GE Healthcare), and quantitated with ImageQuant Software, version 5.0 (GE Healthcare).

Microscopy

Fixed cells or cells from late exponential cultures were pelleted, resuspended in roughly 10% of the original volume of supernatant, affixed to a poly-L-lysine-coated cover slip, and visualized with a DeltaVision Spectris Restoration Microscopy System (Applied Precision) with an Olympus IX70 Inverted System Microscope and a Photometrics Cool-SNAP HQ CCD camera. Data were collected and analyzed with DeltaVision SoftWoRx Image Analysis Software. Seven or eight images were collected as a stack of 0.15 μm increments in the z-axis. Images were deconvolved for 10 cycles in enhanced ratio mode. Deconvolved images are presented unless otherwise indicated.

For time-lapse imaging, growing cells were inoculated directly from a fresh colony onto a 1.2% agar or agarose pad containing 20% or 25% LB medium and appropriate antibiotics and inducers. The slide was incubated at 30° C. and imaged without sectioning at uniform intervals, typically 1, 3, or 5 s, in the Weather Station temperature-controlled chamber outfitted to the microscope (Precision Control). Images were deconvolved as above. The SoftWoRx Image Analysis Software was used to measure filament lengths.

For photokinetics experiments (fluorescence recovery after photobleaching [FRAP]), a 0.5 s pulse at 50% power was delivered from the Quantifiable Laser Module (488 nm) outfitted to the microscope (Applied Precision), and the field was then imaged at uniform intervals as for time-lapse. Three images were taken prior to bleaching. Images were deconvolved as above.

FM 4-64 (Molecular Probes/Invitrogen) was present in slide preparations at 2 μg/ml and in agar pads at 0.2 μg/ml (Pogliano et al., 1999).

Coordinated Alp7A Microscopy and Protein Quantitation

For each strain, a fresh single colony was dispersed in 1 ml LB medium, 100 μl of the suspension was used to inoculate one or more 6 ml cultures of LB medium containing any selective antibiotics, and the cultures were rolled at 30° C. In early exponential phase, the cultures were induced with an appropriate amount of xylose. At the end of 1 h, at which time the culture had typically attained an $OD_{600}$ of between 0.4 and 0.5, 0.5 ml of the culture was added to 20 μl of 1M Na$_x$H$_y$PO$_4$ pH 7.4, and the cells were then fixed at room temperature for 20 min with 0.0063% glutaraldehyde in 2.7% paraformaldehyde. The fixed cells were washed three times with PBS, resuspended in PBS, and examined by fluorescence microscopy.

At the same time, 1 ml of the culture was added to 1 μl of a protease inhibitor cocktail (Sigma P2714, reconstituted according to the manufacturer's instructions), and PMSF was added to 150 μg/ml. The cells were pelleted, frozen in a dry ice/ethanol bath, and stored overnight at −70° C. The thawed cells were resuspended in 60 μl of a buffer consisting of 40% sucrose, 1 mM EDTA, 33 mM TrisCl pH 8.0 with protease inhibitors as above, and treated with 1 mg/ml lysozyme at 37° C. for 10 min. An equal volume of SDS-PAGE sample preparation buffer with 5% β-mercaptoethanol was added to the lysate, and the samples were heated at 80° C. for 10 min. Proteins were fractionated on SDS-PAGE and immunoblotted.

Example 3

Identification of More than 35 New Families of Bacterial Actin

Five families of actins have been characterized in bacteria (e.g., Becker et al., *EMBO J.* 25:5919-5931 (2006)). A bioinformatics approach was used to determine if additional family members exist. A BLAST search was conducted with our recently discovered fifth family member AlfA. Potential new actin sequences that were identified and that were distinct from the five families but still more closely related to actin than to Hsp70 or to the sugar kinases were then used to begin a second round of BLAST searches. New sequences from the second round of searches were used for a third round, and the searches were continued in this manner for several more rounds. A phylogenetic tree that was generated from these new sequences and the five already identified bacterial actin families revealed that the new sequences comprised more than 35 distinct families of bacterial actins that were only distantly related to each other, to MreB, FtsA, ParM, AlfA, and MamK, and to actin itself (FIG. 2A). Although each family shares less that 30% identity with the other families, in each sequence could be found the five actin signature motifs of amino acids that are involved in the binding and hydrolysis of ATP (Bork et al., *Proc Natl Acad Sci USA* 89:7290-7294 (1992)). We have therefore designated these proteins "actin-like proteins" or "Alps" (FIG. 2A).

A remarkable feature of these Alp families is their phylogenetic distance from one another. A single BLAST search with one of these proteins falls far short of revealing the expanse of the tree, turning up members of only a few of the other Alp families. A BLAST search with any member of the Alp7 family, for example, fails to identify the established bacterial actins such as MreB or ParM as statistically significant relatives, and a pairwise alignment between the Alp7 family member Alp7A and either MreB or ParM explains this failure. Alp7A is only 13% identical to MreB and to ParM; it is 11% identical to the entirely unrelated LacI, a protein of about the same length. Nevertheless, the Alp7 family members and all of the other proteins of the tree contain the five conserved motifs of the actin nucleotide binding pocket (Bork, P. et al., *Proc Natl Acad Sci USA* 89:7290-7294 (1992)), and they could be linked phylogenetically to MreB and to ParM if not immediately, than through intermediates in the form of members of other Alp families. The proteins of the tree are all of roughly the same length, about 350 amino acids, and none of them appear to be more closely related either to Hsp70 or to hexokinase.

The annotations accompanying the sequences indicated that the functions of many of these proteins were unknown. Although a few of the genes appeared to be on bacterial chromosomes, for example the members of the Alp32 family, most were on mobile genetic elements, e.g., phage genomes, plasmids, and integrating conjugative elements.

Given the great phylogenetic divergence among the Alps, it remained possible that these proteins shared nothing more than the ability to bind nucleotide in the manner of actin. We sought to determine whether the Alps were truly actins by looking at their polymerization properties within the cell. We chose three Alp sequences, each from a distinct family of our phylogenetic tree. We fused gfp to the respective genes, and we examined the resulting fusion proteins in *E. coli*. These genes were gp207 of *Bacillus thuringiensis* phage 0305ϕ8-36, from the Alp6 family (Thomas et al., *Virology* 368:405-421 (2007)); OrfB from *Bacillus subtilis* natto plasmid pLS20, from the Alp7 family (Meijer et al., *Nucleic Acids Res* 23:3214-3223 (1995)); and orf250 of *Proteus vulgaris* plasmid Rts1, from the Alp8 family (Murata et al., *J Bacteriol* 184:3194-3202 (2002)). As was typical of representatives of these divergent Alp families, these proteins, which we have for simplicity designated Alp6A, Alp7A, and Alp8A, shared less than 22% amino acid sequence identity with one another (average of 17.6±3.4%), but actin signature motifs could be found in all three (FIG. 2B). When produced in *E. coli*, each protein assembled into long filamentous structures that in many cases extended longitudinally through several cells and caused them to grow abnormally as chains in culture (FIGS. 2C, D, and F). The Alp7 family representative, pLS20 OrfB (Alp7A), was also produced without a GFP tag, and gave rise to chained cells as well (FIG. 2E).

Example 4

Alp7A is Required for Plasmid Stability

Even though their sequences share only a tenuous resemblance to that of actin, these three proteins, in the absence of any other elements from the source DNA or from the native host, assembled into filamentous structures in *E. coli*. Like actin, they could polymerize, and they could do so without auxiliary factors when produced at what we assume to be greater than their normal physiological concentrations (Tobacman et al., *J Biol Chem* 258:3207-3214 (1983)). Indeed, all of the ALPs we have tested to date have share this activity. In order to illuminate the connection between these proteins, their polymerization properties, their function, and actin, we chose to study one in detail. The functions of all three proteins were unknown, but the Alp7 family member Alp7A appeared to be a plasmid stability determinant. Actin-like proteins such as ParM are the nucleotide-binding components of one of the two major sets of bacterial plasmid partitioning systems. The genetic organization of these systems is typically tripartite, with a gene that codes for an ATPase, a gene that codes for a DNA-binding protein, and a centromere-like site (Gerdes et al., *Cell* 116:359-366 (2004)). This organization is recapitulated here (FIG. 3A). The gene for Alp7A appears to be cotranscribed with a downstream gene, alp7R, that codes for a 134 amino acid protein whose small size and high percentage of charged residues recalls the DNA-binding protein ParR. The putative alp7AR operon is situated near the pLS20 origin of replication, as is frequently the case for plasmid partitioning systems.

We constructed a plasmid to test for a role of Alp7A in plasmid partitioning. The pLS20 origin region is sufficient for replication (Meijer et al., *Nucleic Acids Res* 23:3214-3223 (1995)). Our plasmid contained both the pLS20 origin of replication and the alp7AR operon (FIG. 3A). However, any origin of replication can be used.

Figure 4:
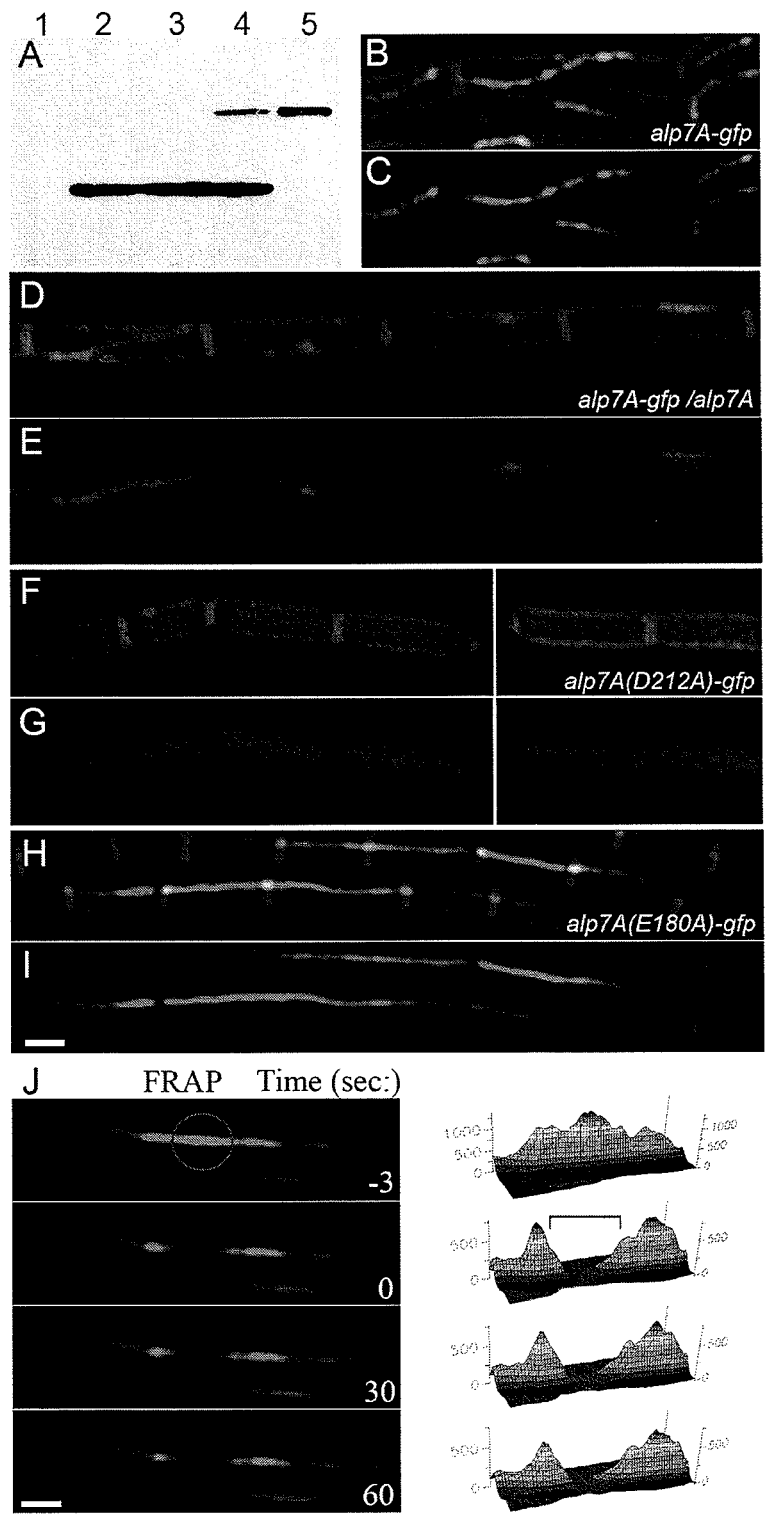
FIG. 4. Alp7A forms filaments in vivo. (A) Immunoblot of *B. subtilis* strain PY79 or transformants of PY79 carrying plasmids containing alp7A or alp7A-gfp: (lane 1) no plasmid; (lane 2) pLS20cat; (lane 3) mini-pLS20; (lane 4) pLS20catalp7A::pMUTINalp7A-gfp; (lane 5) mini-pLS20alp7A-gfp. The filter was probed with anti-Alp7A antisera. (B-I) Fluorescence microscopy images of (B, C) mini-pLS20alp7A-gfp/PY79; (D, E) pLS20catalp7A:: pMUTINalp7A-gfp/PY79 (not deconvolved); (F, G) mini-pLS20alp7A(D212A)-gfp/PY79; (H and I) mini-pLS20alp7A(E180A)-gfp/PY79. (B, D, F, H) Membranes stained with FM4-64. (J) FRAP analysis of Alp7A(E180A)-GFP. Left panel, fluorescence microscopy images pre-bleach, post-bleach, 30 s post-bleach, 60 s post-bleach; right panel, corresponding fluorescence intensity plot (linear scale, arbitrary units). Scale bar (I, J) equals 1 μm; all images are at the same scale.
Figure 5:
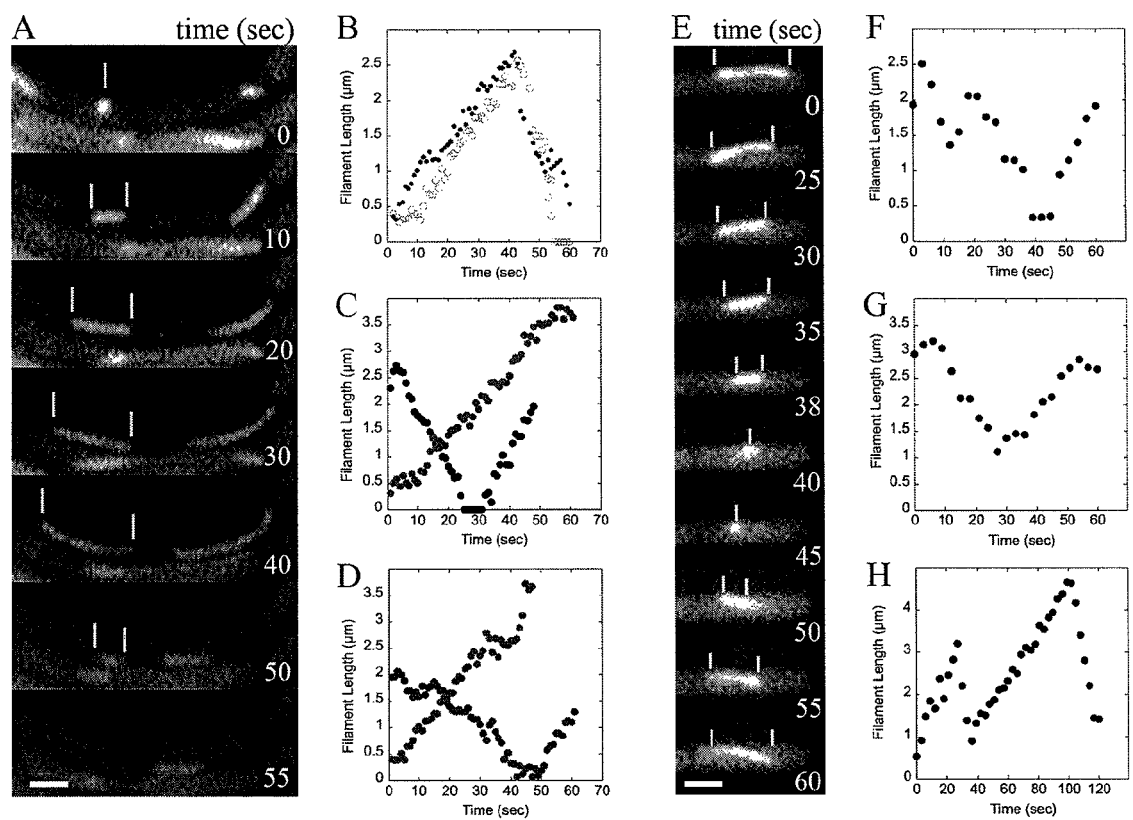
FIG. 5. Alp7A filaments show dynamic instability in vivo. (A) Images from time-lapse fluorescence microscopy of mini-pLS20alp7A-gfp/PY79. Scale bar equals 1 µm; all images are at the same scale. (B-D) Growth and shrinkage of individual filaments. The filaments in (A) are tracked in (B); the white circles correspond to the filament on the left, the blue circles to the filaments on the right. (E) Images from time-lapse fluorescence microscopy of pLS20catalp7A:: pMUTINalp7A-gfp/PY79. Scale bar equals 1 micron; all images are to the same scale. (F-H) Growth and shrinkage of individual filaments. The filament in (E) is tracked in (F).

The steady state level of Alp7A in a strain containing this mini-pLS20 plasmid matched that in a strain containing pLS20 itself, demonstrating that Alp7A expression is equivalent to that from the native plasmid (FIG. 4A, lanes 2 and 3). We assayed the stability of this plasmid in *B. subtilis* over approximately 30 generations of vegetative growth in the absence of antibiotic selection. We assayed in parallel a variant of the plasmid in which we replaced alp7A with an in-frame deletion of the gene, and another variant that contained the pLS20 origin of replication but no alp7AR operon (FIG. 3A).

The plasmid containing both the pLS20 origin of replication and the intact alp7AR operon was as stable as pLS20 itself (Meijer et al., *Nucleic Acids Res* 23:3214-3223 (1995)), and was retained with no loss at all over the 30 generations of the assay (FIG. 3B). In marked contrast, the plasmid containing the alp7A deletion, mini-pLS20Δ(alp7A), was present in only 55% of the cells at 9.5 generations, and in only 2% of the cells by the end of 32 generations, an 8% loss per generation. The plasmid missing the entire alp7AR operon was also unstable, and was present in only 52% of the cells at the end of 33 generations, a 2% loss per generation (FIG. 3B). These data demonstrated that Alp7A is essential for plasmid stability and that it was very likely a component of a plasmid partitioning system. In many such systems, production of the adaptor DNA-binding protein without its nucleotide binding partner is more destabilizing than having no partitioning system at all (Lobocka et al., *J Mol Biol* 259:366-382 (1996)).

Example 5

The Alp7A-GFP Fusion Protein is Functional

Actin and the previously characterized bacterial actins are dynamic cytoskeletal proteins. In order to determine whether Alp7A was as well, we examined the behavior of our C-terminal GFP fusion protein in the context of mini-pLS20. We replaced alp7A on this plasmid with alp7A-gfp (FIG. 3A, bottom). Two lines of evidence indicated that the Alp7A-GFP protein was functionally equivalent to Alp7A and was therefore a reliable reporter of its behavior. First and most importantly, the mini-pLS20 alp7A-gfp plasmid was nearly as stable as mini-pLS20. After 30 generations of growth in the absence of selection, 97% of the cells still retained the plasmid (FIG. 3C). Immunoblotting revealed that it was the intact Alp7A-GFP fusion protein that was functioning in these cells. The fusion protein was stable; no Alp7A was being generated from proteolytic cleavage (FIG. 4A, lane 5).

Second, the fusion protein complemented mini-pLS20Δ (alp7A) as effectively as Alp7A did in a plasmid stability assay. For this experiment, alp7A and alp7A-gfp were each placed under control of the xylose promoter, each was integrated into the *B. subtilis* chromosome in single copy via a double recombination event (FIG. 3D), and mini-pLS20Δ (alp7A) was then introduced into each of the two strains. When the transformants were grown in the presence of xylose and assayed after approximately 21 generations, mini-pLS20Δ(alp7A) was found to be present in both strains in about 75% of the cells (FIG. 3E). In the absence of xylose, fewer than 10% of the cells retained the plasmid. Complementation in the $P_{xylA}$alp7A-gfp strain was again due to Alp7A-GFP itself and not to an Alp7A proteolytic cleavage product; immunoblotting revealed that the fusion protein produced from the chromosome was stable over a range of induction levels (FIG. 3F).

Example 6

Alp7A is a Dynamic Cytoskeletal Protein

We used fluorescence microscopy to monitor the behavior of the Alp7A-GFP protein in growing cells of *B. subtilis*. Nearly all of the cells contained one or more curved filaments (FIGS. 4B and C), and in time-lapse experiments these grew and shrank rapidly (FIG. 5A-D). In some cases, a single filament would grow to the length of the cell, then shrink almost to vanishing, and then grow again to its former length. In most cases, the growth or shrinkage was less extensive, but cycles of growth and shrinkage were always present (FIG. 5A-D). Profiles of several of these filaments from different cells revealed that the rate of growth was a fairly uniform 0.073±0.014 μm/s, and the rate of shrinkage was 0.14±0.040 μm/s (n=11; FIG. 5A-D). This dynamic instability, a property of eukaryotic microtubules, has also been shown to be a property of the bacterial actin ParM.

We observed similar filaments and the same dynamic instability when both Alp7A and Alp7A-GFP were produced from the same plasmid, one that we constructed by integration of a plasmid containing alp7A-gfp via a single recombination event into pLS20 itself (FIG. 4A, lane 4; FIGS. 4D and E). The filament growth rate was 0.062±0.014 μm/s, and the shrinkage rate was 0.14±0.061 μm/s (n=8; FIG. 5E-H). The similarity between this profile and that of mini-pLS20alp7A-gfp was consistent with our finding that Alp7A-GFP and Alp7A are functionally equivalent.

Example 7

Alp7A Function Requires that it Assemble into Filaments that are Dynamically Unstable Polymerization is critical to actin function. In order to determine whether this was so for Alp7A, we introduced two mutations that, based upon biochemical and structural studies with actin, would be expected to alter the polymerization properties of the protein (Kabsch et al., *Nature* 347:37-44 (1990); Belmont et al., *J Cell Sci* 112:1325-1336 (1999)). We focused upon residues whose side chains, as opposed to backbone amides, interact with nucleotide (Kabsch et al., *Nature* 347:37-44 (1990)).

Amino acid D212 in Alp7A corresponds to amino acid D154 in actin and is located in the Phosphate 2 sequence (FIG. 2B). The D154 side chain carboxylate interacts with the β and γ phosphates of ATP and with the β phosphate of ADP through a bound divalent cation (Kabsch et al., *Nature* 347:37-44 (1990)). A mutation to alanine was introduced into mini-pLS20 and into mini-pLS20alp7A-gfp. The mini-pLS20alp7A(D212A)-gfp plasmid did not give rise to filaments in *B. subtilis*; instead the diffuse fluorescence present throughout the entire cell indicated that the mutant protein, although present at the same steady state levels as the wild-type protein, did not assemble into higher order structures (FIGS. 4F and G). In a plasmid stability assay, the mini-pLS20alp7A(D212A) plasmid was as unstable as mini-pLS20Δ(alp7A) (FIG. 4C). As is the case for actin, its ability to assemble into filaments is essential to the function of Alp7A.

Amino acid E180 in Alp7A corresponds to amino acid Q137 in actin and is located in the Connect 1 sequence (FIG. 2B). The Q137 side chain amide interacts with the same cation as does the side chain carboxylate of D154 (Kabsch, W. et al., *Nature* 347:37-44 (1990)). A mutation to alanine was introduced into mini-pLS20 and into mini-pLS20alp7A-gfp. The mini-pLS20 alp7A(E180A)-gfp plasmid produced wild-type levels of protein, but gave rise to filaments in *B. subtilis* that were unlike those of the wild-type (FIG. 4H-J). Whereas all of the wild-type filaments were contained entirely within a cell, many of the E180A filaments extended from one cell into the next, or even through a row of cells (FIG. 4H). And whereas the wild-type filaments were dynamically unstable, undergoing rapid cycles of polymerization and depolymerization, the E180A filaments were static. In time-lapse experiments, there were no dynamics observed, and in fluorescence recovery after photobleaching experiments (FRAP), there was no recovery of fluorescence even one minute after photobleaching (FIG. 4J). In a plasmid stability assay, the mini-pLS20alp7A(E180A) plasmid was nearly as unstable as mini-pLS20Δ(alp7A), and was present in only 18% of the cells at the end of 31 generations (FIG. 3C). As is the case for actin, and also for ParM and AlfA, the ability to assemble into dynamic filaments is essential to the function of Alp7A.

Example 8

Production of Dynamic Filaments Requires Additional Elements of pLS20

Our early efforts at intracellular production of Alp7A, in which filaments were observed to form in the absence of any other elements from pLS20 or from the native host, demonstrated that the ability to polymerize into filaments was most likely an intrinsic property of the protein (FIG. 2D). Subsequent experiments supported this conclusion. Alp7A-GFP, so long as it was produced at sufficiently high levels, gave rise to filaments, but to static filaments only.

Figure 6:
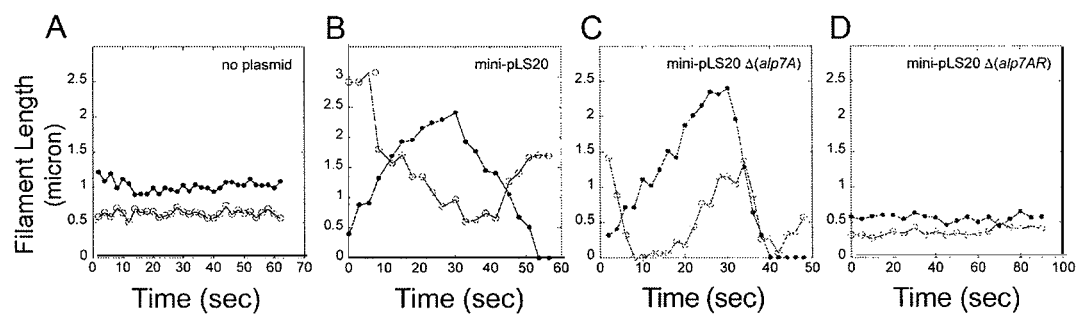
FIG. 6. Production of dynamic filaments requires additional elements of pLS20. (A-D) Filament length (microns) as a function of time (seconds) of two representative filaments in strain PY79 thrC::xylR$^+$P$_{xylA}$alp7A-gfp containing (A) no plasmid (see Movie S7); (B) mini-pLS20 (see Movie S8); (C) mini-pLS20Δ(alp7A) (see Movie S9); (D) mini-pLS20Δ (alp7AR).

In order to identify any extraneous elements required to produce dynamic filaments, we surveyed the behavior of Alp7A-GFP in several contexts by time-lapse microscopy. We observed dynamic filaments when Alp7A-GFP was produced in a strain containing pLS20 and this was so whether the alp7A-gfp gene was expressed from the same DNA macromolecule, as in the integrant described above (FIG. 5E-H) or from the chromosome. The entirety of pLS20 was not required; mini-pLS20 sufficed (FIG. 6B), and mini-pLS20Δ (alp7A) sufficed as well (FIG. 6C). But mini-pLS20Δ (alp7AR) did not; we did not observe dynamic filaments when alp7A-gfp was expressed in a cell containing only mini-pLS20Δ(alp7AR) with no other elements from pLS20 (FIG. 6D). One or more requirements for dynamic Alp7A filaments was therefore contained in 674 bp of pLS20 DNA that was present on mini-pLS20Δ(alp7A) but not on mini-pLS20Δ(alp7AR). Within this 674 bp are alp7R, the second gene of the putative operon, and the 165 bp of DNA that lies directly upstream of the alp7A initiation codon (FIG. 3A).

Example 9

Figure 7:
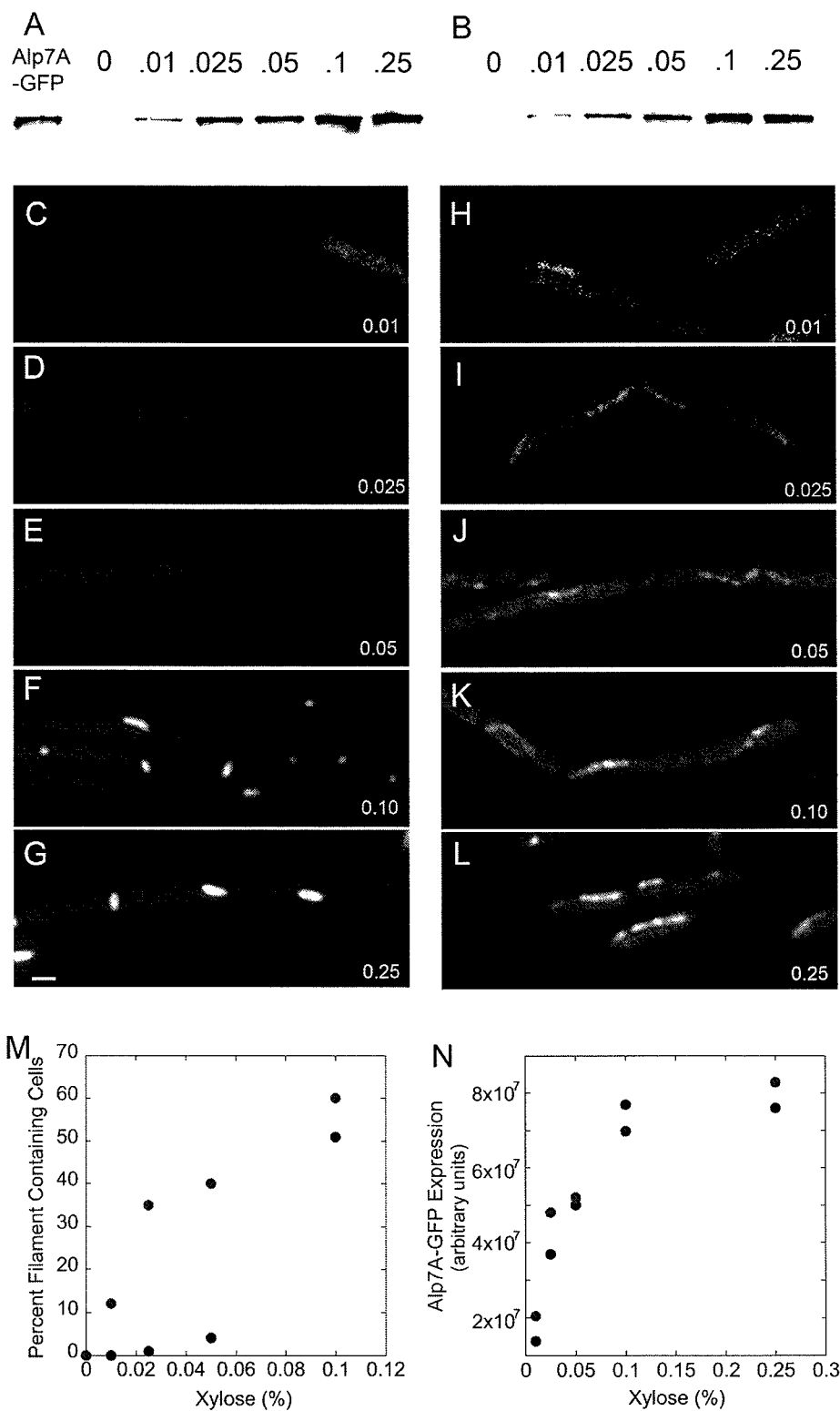
FIG. 7. DNA containing alp7R and the DNA directly upstream of alp7A lowers the critical concentration for Alp7A filament formation. B. subtilis strain PY79 thrC:: xylR$^+$P$_{xylA}$alp7A-gfp has a chromosomal copy of alp7A-gfp expressed from the xylose promoter (FIG. 3D). This strain or a transformant containing the mini-pLS20Δ(alp7A) plasmid were grown in various concentrations of xylose, and alp7A-gfp expression was monitored by immunoblot with anti-Alp7A antisera. (A-B) Xylose-induction profile of the strain lacking the mini-pLS20Δ(alp7A)plasmid (A) or containing the plasmid (B); (A, first lane) Alp7A-GFP produced from mini-pLS20alp7A-GFP. (C-L) Fluorescence microscopy images of glutaraldehyde-fixed cells of the strain lacking the plasmid (C-G), or containing the plasmid (H-L) after induction with xylose for 1 h at (C and H) 0.01%; (D and I) 0.025%; (E and J) 0.05%; (F and K) 0.10%; (G and L) 0.25%. Scale bar (G) equals 1 µm; all images are at the same scale. (M) Percentage of cells containing at least one filament in strains containing the plasmid (green circles) or lacking the plasmid (black circles) after xylose induction. At least 100 cells were scored for each xylose concentration. (N) Quantitation of immunoblots in (A) black circles, and (B) green circles.

DNA Containing alp7R Lowers the Critical Concentration for Alp7A Filament Formation This segment of DNA containing alp7R not only determined whether Alp7A dynamic filaments would assemble, but also at what concentration they formed. We examined the ability of Alp7A-GFP to assemble into filaments at various intracellular concentrations in either the presence or absence of the mini-pLS20Δ(alp7A) plasmid, which has the segment, by counting the number of cells that contained at least one filament. When alp7A-gfp was expressed in the absence of the plasmid, there were no filaments in the cells at xylose induction levels of 0.025% or below; the Alp7A-GFP that was produced accumulated in the cells only as soluble protein (FIGS. 7C, D, and M). Even at 0.05% xylose, filaments were present in fewer than 5% of the cells (FIGS. 7E and M). Only at 0.1% xylose and higher were filaments present in 50% of cells (FIGS. 7F, G and M). Yet immunoblotting experiments demonstrated that the steady state levels of Alp7A-GFP increased as expected with increasing concentrations of xylose (FIGS. 7A and N). We therefore concluded that there was a critical intracellular concentration that must be attained for Alp7A to polymerize into filaments.

This critical concentration was lowered when mini-pLS20Δ(alp7A) was present in the cell. At 0.05% xylose, nearly 40% of the cells had filaments (FIGS. 7J and M). Indeed filaments were present in the cells at xylose concentrations as low as 0.01% (FIG. 6H-L and M). In contrast, in the absence of the plasmid, fewer than 5% of the cells contained filaments at 0.05% xylose, even though physiological levels of Alp7A-GFP were produced (FIG. 7A). For any given concentration of the inducer xylose, the same amount of Alp7A-GFP was produced in both strains (FIGS. 7A, B, and N). Hence pLS20 DNA containing alp7R and the region upstream of alp7A lowered the critical concentration for Alp7A filament formation.

Example 10

Alp7A Filaments Colocalize with Plasmids

Figure 8:
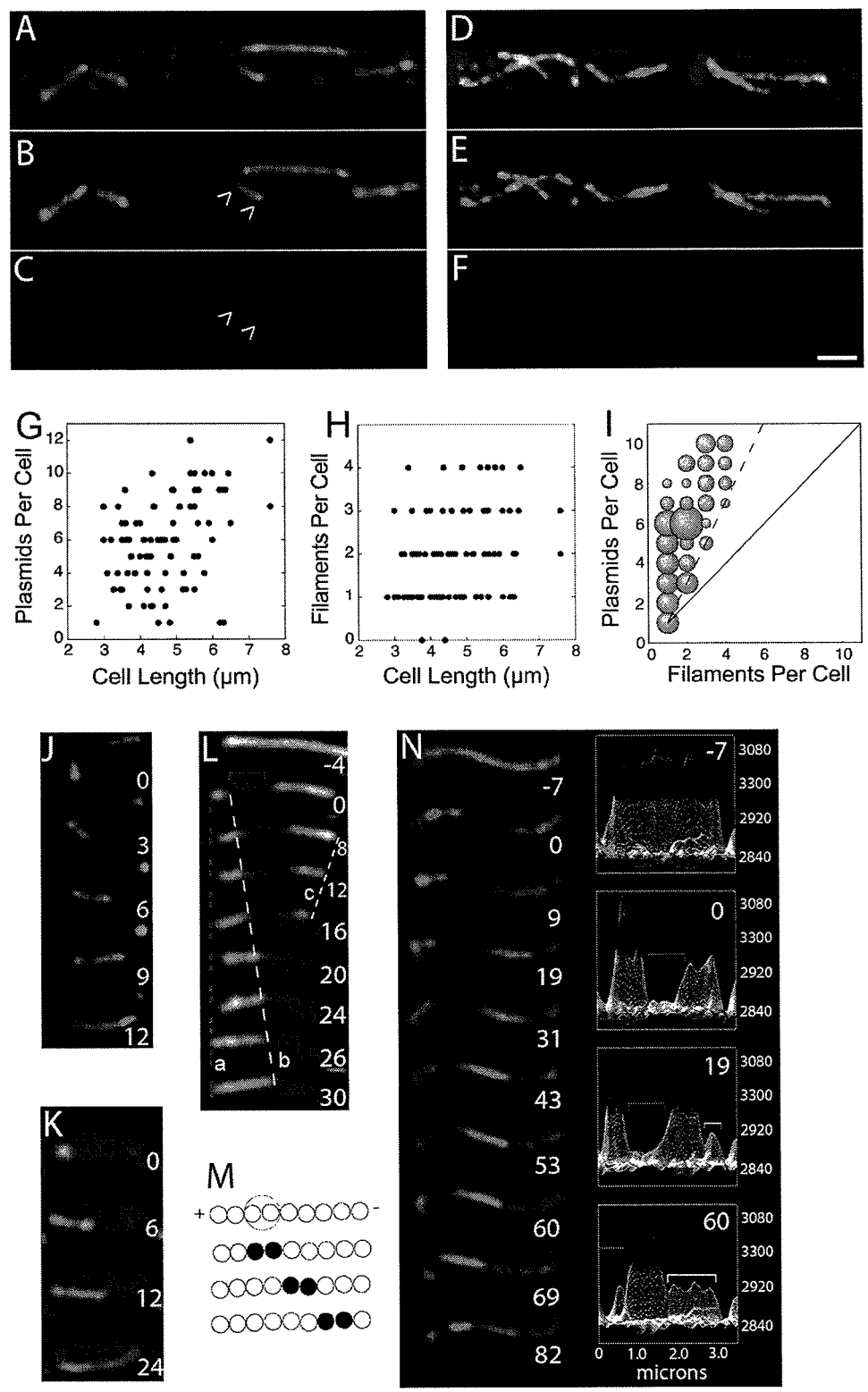
FIG. 8. Alp7A filaments colocalize with mini-pLS20, push plasmids apart, and treadmill. (A-F) Fluorescence microscopy images of fixed cells containing LacI-CFP tagged mini-pLS20alp7A-gfp. (A and D) Membranes (FM 4-64) and filaments (Alp7A-GFP); (B and E) Plasmid foci (LacI-CFP) and filaments (Alp7A-GFP); (C and F) Plasmid foci (LacI-CFP). Scale bar equals 1 µm; all images are at the same scale. (G) Plasmids per cell vs. cell length. (H) Filaments per cell vs. cell length. (I) Plasmids per cell vs. filaments per cell. The area of the spheres corresponds to the number of occurrences. For (G-I), 91 cells containing 173 filaments and 546 plasmid foci were examined. There was an average of 5.9 plasmid foci per cell, which is consistent with the reported plasmid copy number (Meijer, W. J. et al., Nucleic Acids Res 23:3214-3223 (1995)), and there was an average of 1.9 filaments per cell. (J and K) Time-lapse of growing cells containing LacI-CFP tagged mini-pLS20alp7A-gfp, showing plasmids (blue) pushed apart by a filament (green). Images were collected at the indicated time intervals (seconds). (L) Photobleaching analysis reveals treadmilling behavior. A pre-bleach image (−4 seconds) and post-bleach images that were collected at 4 second intervals are shown. The distance between the left end of the filament (line a) and the bleached zone boundary (line b) increases with time, as the right end undergoes depolymerization (line c). (M) A schematic illustrating how fluxing can occur. If a filament containing a plus and minus end is treadmilling in place, then after photobleaching a small region (red circle), the bleached subunits (black circles) will "flux" in one direction as new subunits add to the plus end. (N) Photobleaching of filaments containing plasmids (blue) at each end. A pre-bleach image (−7 s) and 9 post-bleach images taken at the indicated times (seconds) are shown (left panel) beside three dimensional GFP fluorescence intensity plots corresponding to selected time points (right panel). Over time, the bleached zone (red bracket in plots) moves to the left as a region of lower fluorescence intensity (white bracket) increases in length.

With Alp7R is a DNA-binding protein, we sought to confirm that Alp7A filaments assemble on the plasmid. If this were so, each filament would be associated with a plasmid in the cell. We tagged the mini-pLS20alp7A-gfp plasmid for fluorescence microscopy by introducing into the plasmid a tandem lac operator array and expressing lacI-cfp from a single copy integrant in the *B. subtilis* chromosome, and we recorded the relative positions of plasmid foci and Alp7A-GFP filaments in fixed cells. Indeed, in 99% (n=175) of the cases, filaments colocalized with plasmid foci (FIG. 8A-F). We also observed complete coincidence of foci and filaments in time-lapse experiments with growing cells (100%, n=45). Foci were typically found at the ends of filaments as would be expected if filament assembly occurred on the plasmid (FIG. 8A-C, arrowheads), but they could be found in the middle of filaments as well. Further support for the idea that filament formation begins at a plasmid came from tallying the number of plasmid foci and filaments per cell. Although there was little to no correlation between the length of a cell and the number of foci or the number of filaments within it (FIGS. 8G and H), there was a relationship between the number of foci and the number of filaments within a cell. As the number of foci per cell increased from 1 up to 10, the number of filaments per cell increased from 1 up to 4 (FIG. 8I). These findings are consistent with a mechanism in which plasmids serve as sites of assembly for Alp7A filaments.

Time-lapse experiments revealed the salient features of the plasmid partitioning mechanism. Separation of plasmid foci was achieved by filament elongation between them, and the rate of separation was consistent with the rate of filament elongation (FIGS. 8J and K). But separation was not always a simple binary operation, with a single focus at each end of a filament. For example, a focus at one end of a filament could split, giving rise to two foci that would then be separated from each other by a second elongating filament. This would result in three foci being separated by two growing filaments. This process generates one focus that appears in fixed cells to be situated in the middle of a single filament (FIG. 8A-F); in reality the focus is bridging two separate filaments.

Example 11

Alp7A Filaments are Capable of Treadmilling

After plasmids were separated, filaments could remain assembled and fully elongated, but it was not clear if they still retained their dynamic properties. We therefore monitored these filaments after marking them by photobleaching. An example of such an experiment is presented in FIG. 8L. An internal section of the filament was bleached with a laser—the red bracket demarcates the bleached zone—and images were captured over the next 30 seconds. As polymerization proceeded at the left end of the filament and depolymerization proceeded at the right end, the photobleached zone migrated rightward. Although the position of the filament within the cell was essentially unchanged, addition of new subunits at the left end pushed to the right the subunits already within the filament (FIGS. 8L and M). Immediately post-bleach, the filament retained its full length as the addition of new subunits at the left end was offset by the loss of subunits from the right end. But by 8 seconds post-bleach, depolymerization had outpaced polymerization and the process of filament disassembly was underway (FIG. 8L, line c).

FIG. 8N illustrates the same behavior in a cell containing CFP-LacI tagged plasmids at the filaments ends. Here photobleaching of the filament also resulted in the bleaching of part of the cytoplasmic Alp7A-GFP pool, so Alp7A filament polarity could be inferred from the observation that new (and distinctly dimmer) subunits were incorporated only at the right end of the filament. As in the filament of FIG. 8L, fluxing occurred as the bleached subunits (left bracket) were pushed to the left by the addition of subunits (right bracket) to the right end. The data of FIGS. 8L and N indicate that in addition to undergoing periods of rapid growth and shrinkage that are characteristic of dynamic instability, Alp7A-GFP filaments can also treadmill. We observed treadmilling only in fully elongated filaments. Plasmid foci were present at the ends of these filaments, suggesting that treadmilling occurs after plasmid separation.

Example 12

Modulation of the ALP7 Stability System for Limited Stability

The stability conferred by the ALP7 orf can be reduced so that a mobile genetic element (e.g., plasmid) can be retained for a limited amount of time. This can be useful where expression of a recombinant protein is not desired beyond a certain timeframe. In particular, two substitutions in the ALP7A protein can provide either rapid, or slow loss of plasmid stability.

FIG. 10 shows the effect of the two ALP7A point mutations, where the proteins are expressed in the miniPLS20 plasmid. As shown above, miniPLS20 expressing wild type ALP7AR is stably maintained for more than 30 generations. FIG. 10A shows that ALP7A(D218N) results in nearly the same level of stability as the plasmid lacking the ALP7 stability system (knockout). Substitution of the aspartic acid at 219, however, results in a slower loss of stability. ALP7A (D219N) is maintained at closer to wild type levels (FIG. 10B).

Example 13

Use of the ALP7A Stability System to Confer Competence in Bacteria

In the commonly used laboratory strain *Bacillus subtilis* 168, competence requires the expression of a set of com genes whose products assemble into a complex in the inner membrane that actively translocates DNA into the cell. Expression of the com genes is under the control of the transcription factor ComK, and cells become competent when ComK accumulates in the cells. Many strains of *Bacillus* have been identified that contain all of the com genes necessary for competence, but the signals necessary to express the genes are unknown. The expression of the *B. subtilis* ComK protein in these untransformable strains is sufficient to make them competent. But because these strains are untransformable, it is always very difficult if not impossible to introduce a ComK expression plasmid into these strains.

We developed a general strategy to genetically manipulate strains of *Bacillus* that relies upon the ability to activate the competence pathway in these bacteria. The strategy employs a novel plasmid that:
  can replicate in most strains of *Bacillus;*
  is stably inherited based on expression of an ALP stability system;
  can be easily transferred into untransformable strains of *Bacillus* by conjugation;
  expresses the comK gene so as to enable the *Bacillus* strains to become competent to take up DNA.

Currently the only methods for introducing plasmid DNA into untransformable *Bacillus* strains are electroporation, protoplast transformation, and conjugation, each which has serious drawbacks. Electroporation is rarely successful with *Bacillus*. Protoplast transformation is difficult, unreliable, and inefficient. Conjugation requires that the plasmid DNA contain a mobilization region comprising an origin of transfer. None of these methods can be use to introduce chromosomal mutations. Chromosomal mutations can be moved from one strain to another by bacteriophage-mediated transduction, but transduction cannot be used to generate new mutations on the chromosome and can be used only with a few strains of *Bacillus* for which phage capable of transducing DNA have been identified.

The strategy for conferring competence in untransformable bacteria utilizes a plasmid with the following components. The comK gene is expressed from the xylose inducible promoter. The plasmid contains a mobilization region comprising an origin of transfer, allowing it to be mobilized via conjugation. Any mobilization region can be used, as these are promiscuously active in bacteria. Once the plasmid is transferred into the recipient strain, natural competence can be activated by the addition of xylose to the media.

This general system allows many species of *Bacillus* of industrial importance to be rendered competent and therefore easily manipulated genetically. Our results show that the stable comK system works in *B. subtilis, B. megaterium, B. amyloliquefaceins, B. thuringiensis, B. licheniformis, B. sphericus, B. anthracis,* and *B. cereus.* Other related *Bacillus* species are expected to be rendered transformable using the same competence system.

In some strains of *Bacillus*, functional com genes may not be present; we have also designed a variant plasmid that expresses from the xylose promoter all of the com genes known to be required for DNA uptake. This plasmid can thus be used for making any bacterial strain competent to take up DNA.

The comK plasmid is stably inherited in *Bacillus subtilis* in the absence of antibiotic selection. The pUB110 mobilization region was added so that the plasmid can be mobilized by conjugation. The plasmid vector can replicate in both *E. coli* and *Bacillus*, allowing easy genetic manipulation.

The comK gene from *B. subtilis* PY79 was cloned into the pBEV1 expression vector under control of the xylose promoter. In the absence of xylose the comK gene is repressed. In the presence of xylose, the comK gene is expressed. Expression of ComK turns on com genes involved in DNA uptake, such as the comF and comG genes. Two different assays were used to determine if the plasmid expressing ComK induced genetic competence. First, we examined expression of comF-lacZ and comG-lacZ fusions upon expression of ComK from the pBEV1 plasmid. Second, we measured the ability of *Bacillus* cells to take up exogenously added plasmid DNA.

The plasmid was introduced by transformation into PY79 cells containing fusions of lacZ to the comF or comG genes. These gene are required for competence, and expressed in response to comK. pBEV1 vector alone (no comK) and plasmid pWH1520 (no comK or alp7AR plasmid stabilization system) were used as negative controls. Upon induction of comK expression with xylose, the colonies of the reporter strains appeared blue, indicating that expression of *B. subtilis* comK from pBEV1 is sufficient to induce expression of competence genes. The negative control cells did not show the blue lacZ coloration.

Xylose was added to exponential phase cultures of PY79 containing pBEV1 or pBEV1-comK for 45 min, the cells were pelleted and resuspended in a small quantity of the growth medium, and 5 ug of plasmid pHCMC04 were added to the suspensions. After brief incubation at 30 C., the cells were spread onto plates containing the selective antibiotic for pHCMC04. Thus, the cells that were not transformed with pHCMC04 would not grow to develop colonies. The plates were incubated overnight at 30 C. The strain containing pBEV1-comK gave rise to several thousand colonies, whereas the strain containing pBEV1 alone gave rise to fewer than 50 colonies, indicating that the induction of comK from pBEV1-comK leads to the development of genetic competence.

It is understood that the examples and embodiments described herein are for illustrative purposes only and that various modifications or changes in light thereof will be suggested to persons skilled in the art and are to be included within the spirit and purview of this application and scope of the appended claims. All publications, patents, and patent applications cited herein are hereby incorporated by reference in their entirety for all purposes.

VI. Informal Sequence Listing

```
Alp7A from pLS20 Bacillus subtilis
                                                        (SEQ ID NO: 1)
MNISRMNVDFGNSMYMNLIDGYFFELPTNVVEISKEAAEGKFTSIVEDPADLKDRLLVS

TVIDETERYFLVGELAEPEVLGNQHIKKLHNKVESHIPYVTFLAATAYYQALKGKREDN

EVTIEYFQTMLPIWLLKKLDKFSEMQKRMASKFLGTHQVKVLTLGLEKELTIKVEDAAC

RIESEVARWAIKKNFDLEDKDYAEQFKNYDVVFCDLGGGTDDLVLLPAGLKPPKSRDSF

VSNTEAPFLAHLEKLRKEKLLEHFDSVRELEKFIYSNIGKTKMERRDGNTGQKFDLTDII

KKSLKEYTEIKIAQAENTFPAPKDKVYKYLYFGGVGEVLEESISVVTEERYGRDISESNHI

VAEDARLLNLYGLEVLSRAEQVKKQANEKEAQSI

Alp7 gi|75758323 [Bthuringiensis serovar israelensis ATCC 35646]
                                                        (SEQ ID NO: 2)
MKITMMNKDSGNSLDMNLIDGFYIETPTNVVEISKDEADSHFVATITNPKELLSRLLISTT

IPGEDTERFFLVGDEAGKHALANNHVNKLHDKITSPIPYVMFLSAVSFYHAINETRESDD

NTVEIEYFQTMLPIWLLKRTAKFSEAQNAMAERFAGEHEVTIHTPGMEKTLKITVEKAT

CRIEGEIARLAIKKNFELEDREEARQFDNNDTVLVDIGGGTIDLVLSPAGLKSPKNRDSM

QPIDKLSYLSHIEKLRKEKFLEKFSDLRSFETFIVNNFQKPKMELVDGNTGQRVDLTDKIR

SSLKEFAKFLILKIQDVMPAPADKVYKYVYFGGVAPILETSIHEVIEEMYGAEIAQANHIF

LPDSRKLNLYGLEVKSRGEMLQKTEK

Alp7 pBM400_p39 [Bacillus megaterium]
                                                        (SEQ ID NO: 3)
MRCIDMKISRFNKDCGNSVDMNIIDGYLFDFPTNVVELQKEAADSFFTDAVTAPEEFKK

RILLSTTIGDEEKERYFLVGDIAASQQLANNHINRLHNKITSHIPYVTFLAAIAYYNALHA

KDQKDTSIEIDYFSTMLPIWLLKKESTFGEAQKAMANRFVGDHTFHIHTPGFERELKVSV

EESSCLKEGEIARFALKKDLTLQDREDANEYVECETVMVDIGGGSIDVVILPEGLKAANS
```

-continued

RESFQSIEGIPYLAHIDKLRKEKFPELFTDLRAFDQFILDNYNKQKFELKNENTGESIDLTV

QIKSSLKEYVEILLAKLNDVAPPPANKLRKYVYCGGVAPTLEVAIMNSMGEKIGEERTE

KYHKVPET

Alp7 pFR55_ORF058gi|166091597|[*Bacillus thuringiensis*]
(SEQ ID NO: 4)
MKIGRKVADFGNSFNNFTVDGYYFELATNVVKVSKKKAEDLLVERILNPEDLLDRLLIS

TEIDGEESYYVLGQLAEDNQLANSHVNKMHDKIKSPIPYISFLGAIAYYHALNADKEDD

EVEIDYMSMMLPIWLLKREEKFSIAHKMMEQRFIGEHKVKVLTPGMERELTITVNSAKC

RNESEIARHSLKYKMVAKDKNSNVISIEKRLEAEKFDDFEVVLTDIGGGSTDAVRLGKG

LTTPKHRDSFQVIDIEPFLGYIDRFRKEKVLQYFKDLRTLETFIVKNYKDQEYVLIDENTG

QEHDFTSEIVEALQEYAKILVAKVLDVFIPSSTNTVLKFIYIGGEAPVLEPYIRLALLEHM

NETAAKNNHFFLSDIIKHDEKEIFAPTSRTINLAALELKAIDETKEQLA

Alp7 pSOL1CAP0126 gi|15004829|[*Clostridium acetobutylicum*]
(SEQ ID NO: 5)
MNIKRFNADFGNSTGNFLIDGYYFEIPTNIVEISSKKAEGMFVSPITEKNELLDRLMISTGE

KENEKFYLVGEFAQGHEIKTHVNQMNDKLTSIIPYANFLGAVAYYAILKNPSEEKEINVE

IDNMKMMLPIWILKKASKFSVAQNQMAARFLGEHTVKVLTMGMERIIKIKVNNSVCKIE

SEVARYAIKYKMVQEDKIIKILPRANLSDKFTKCETVLCDFGGGSIDCVKLGEGLTPPKA

RDSFKVIDIEPFLGWLETFRKEKVLQYFYSIKQIEKFLINNYKKQKYILEDPNTGKSYDFT

SKFTEMLQDYSDKLVPVIFNTFKETDRLLKFVYFGGESPVLKPYIKKTLLKFVTEKVAEE

NHIFLDDLLENDTSEVFKPTSRTINLTALELLSISEVTKNKSSEKNE

ALP7 gi|229168012|ref|ZP_04295742.1|hypothetical protein
bcere0007_29710 [*Bacillus cereus* AH621]
(SEQ ID NO: 6)
MKINMMNKDSGNSLDMNLIDGFYIETPTNVVEISKDEADSHFVATITNPKELLSRLLISTT

IPGEDTERFFLVGDEAAKHALANNHVNKLHDKITSPIPYVMFLSAISFYHAINEQRESDD

NTIEIEYFQTMLPIWLLKRTAKFSEAQNAMAERFAGEHEVTIHTPGMEKTLKITVEKATC

RIEGEIARLAIKKNFELEDREEASQFDNNDTVLVDIGGGTIDLVLSPVGLKSPKNRDSMQP

IDKLSYLSHIEKLRKEKFLEKFSDLRSFETFIVNNFQKPKMELVDGNTGQRVDLTDKVRS

SLKEFAKFLILKIQDVMPAPADKVYKYVYFGGVAPILEASIHEVIEEMYGAEIAQANHIFL

PDSRKLNLYGLEVKSRGEMLQKTEK

ALP7 gi|229141745|ref|ZP_04270274.1|hypothetical protein
bcere0013_48340 [*Bacillus cereus* BDRD-ST26]
(SEQ ID NO: 7)
MMNKDSGNSLDMNLIDGFYIETPTNVVEISKDEADSHFVATITNPKELLSRLLISTTIPGE

DTERFFLVGDEAGKHALANNHVNKLHDKITSPIPYVMFLSAVSFYHAINETRESDDNTV

EIEYFQTMLPIWLLKRTAKFSEAQNAMAERFAGEHEVTIHTPGMEKTLKITVEKATCRIE

GEIARLAIKKNFELEDREEARQFDNNDTVLVDIGGGTIDLVLSPAGLKSPKNRDSMQPID

KLSYLSHIEKLRKEKFLEKFSDLRSFETFIVNNFQKPKMELVDGNTGQRVDLTEKIRSSLK

EFAKFLILKIQDVMPAPADKVYKYVYFGGVAPILETSIHEVIEEMYGAEIAQANHIFLPDS

RKLNLYGLEVKSRGEMLQKTEK

ALP7 gi|229100588|ref|ZP_04231438.1|hypothetical protein
bcere0020_57600 [*Bacillus cereus* Rock3-29]
(SEQ ID NO: 8)
MKITMMNKDSGNSLDMNLIDGFYIETPTNVVEISKDEADSHFVATITNPKELLSRLLISTK

IPGEDTERFFLVGDEAAKHALANNHVNKLHDKITSPIPYVMFLSAVSFYHAINEQRESDD

NTIEIEYFQTMLPIWLLKRTAKFSEAQNAMAERFAGEHEVTIHTPGMEKTLKITVEKATC

-continued

RIEGEIARLAIKKNFELEDREEARQFDNNDTVLVDIGGGTIDLVLSPTGLKSPKNRDSMQP

IDKLSYLSHIEKLRKEKFLEKFSDLRSFETFIVNNFQKPKMELVDGNTGQRVDLTDKVRS

SLKEFAKFLILKIQDVMPAPADKVYKVYFGGVAPILETSIHEVIEEMYGAEIAQANHIFL

PDSRKLNLYGLEVKSRGEMLQKIER

ALP7 gi|229082948|ref|ZP_04215369.1|hypothetical protein
bcere0023_55370 [*Bacillus cereus* Rock4-2]
(SEQ ID NO: 9)
MNLIDGFYIETPTNVVEISKDEADSHFVATITNPKELLSRLLISTTIPGEDTERFFLVGDEA

GKHALANNHVNKLHDKITSPIPYVMFLSAISFYHAINETRESDDNTIEIEYFQTMLPIWLL

KRTAKFSEAQNAMAERFAGEHEVTIHTPGMEKTLKITVERATCRIEGEIARLAIKKNFEL

EDREEARQFDNNDTVLVDIGGGTIDLVLSPAGLKSPKNRDSMQPIDKLSYLSHIEKLRKE

KFLEKFSDLRSFETFIVNNFQKPKMELIDGNTGQRVDLTDKIRSSLKEFAKFLILKIQDVM

PAPADKVYKVYFGGVAPILETSIHEVIEEMYGAEIAQANHIFLPDSRKLNLYGLEVKSR

GEMLQKTEK

ALP7 gi|229009322|ref|ZP_04166606.1|hypothetical protein
bmyco0002_60080 [*Bacillus mycoides* Rock1-4]
(SEQ ID NO: 10)
MKIGRKVADFGNSFNNFMVDGYYIELATNVVKISKKKAEDLLVDRISRPEDLLDRLLIST

EIDGEESFYLVGQLAEDNQLANSHVNKMHDKINSPIPYISFLGAIAYYHALNAEQEDNVV

EIENMSMMLPIWLLKREEKFSIAHKKMEERFTGEHKVKVLTPGMERELTITVNSAKCKN

ESEVARHSLKYKMVSKDKNTSVISIEKRYESERFDDYEVVLTDIGGGSTDAVRLGKGLT

TPKHRDSFQVIDVEPFLGYLERFRKEKLIQYFKDLRTLEKFIVNNYKEQKYVLSNENTGE

EYDFTTEIVEALKEYARILVAKVLDVFIPSSTNTVLKFIYIGGEAPVLEPYIRLALLDHMSE

TAAKNNHFFLNDIIQNSEKEVFAPTSRTINLAALELKAIDEMKGQLA

ALP7 gi|228994350|ref|ZP_04154236.1|hypothetical protein
bpmyx0001_50640 [*Bacillus pseudomycoides* DSM 12442]
(SEQ ID NO: 11)
MKIGRKVADFGNSFNNFMVDGYYIELATNVVKISKKQAEDLLVDRISRPEDLLDRLLIST

EIEGEESFYLVGQLAEDNQLANSHVNKMHDKINSPIPYVSFLGAIAYYHALNAEQEDNE

VEIEHMSMMLPIWLLKREEKFSIAHKKMEERFIGEHKVKVLTPGMEKELTIRVNSAKCR

NESEVARHSLKYKMVSKDQNTNVISIEKRYESERFDDYEVVLTDIGGGSTDAVRLGKGL

TTPKHRDSFQVIDIEPFLGYLERFRKEKLIQYFKDLRTLEKFIVNNYKVQKYVLSNENTGE

EYDFTNEIVEALKEYARILVAKILDVFIPSSTNTVLKFIYIGGEAPVLEPYIRLALLNHMSE

MAAKNNHFFLNDIIQNSDKEVFAPTSRTINLTALELKVIDEMKGQLA

ALP7 gi|228962224|ref|ZP_04123662.1|hypothetical protein
bthur0005_55780 [*Bacillus thuringiensi* sserovar *pakistani* str.
T13001]
(SEQ ID NO: 12)
MMNKDAGNSLDMNLIDGFYIETPTNVVEISKDEANSHFVATITNPKELLSRLLISTTIPEE

DTERFFLVGDEASKHALANNHVNKLHDKTTSPIPYIMFLSAISFYHAINETRESDENTIEIE

YFQTMLPIWLLKRTAKFSEAQHAMAARFTGEHEVTIHTPGMEKTLKIIVEKAICRIEGEIA

RLAIKKNFELEDREEARQFDDNDTVLVDIGGGTIDLVLSPAGLKSPKNRDSMQPIDKLSY

LSHIEKLRKEKFLEKFSDLRSFETFIVNNYQKPKMELVDGNTGQRIDLTEKIQSSLKEFAR

FLILKIQDVIPAPSDKVYKVYFGGVAPILKTNIHEVIEEMYGAEIAQANHIFLPDSRKLN

LYGLEIKSRGEMLQKTKK

ALP7 gi|228936872|ref|ZP_04099626.1|hypothetical protein
bthur0009_52840 [*Bacillus thuringiensi sserovar andalousiensis* BGSC
4AW1]

(SEQ ID NO: 13)

MKINMMNKDSGNSLDMNLIDGFYIETPTNVVEISRDEADSHFVASITNPKELLSRLLISTT

IPGEDNERFFLVGDEAAKHALANNHVNKLHDKITSPIPYIMFLSAISFYHAINEQREPDDN

TVEIKYFQTMLPIWLLKRTAKFSEAQNAMAERFAGEHEVTIHTPGMGKTLKITVEKATC

RIEGEIARLAIKKNFELEDREEARQFDNNDTVLVDIGGGTIDLVLSPAGLKSPKNRDSMQ

SIDKLSYLSHIEKLRKEKFLEKFSDLRSFETFIVNNFQKPKMELIDGNTGQRIDLTDKLRSS

LKEFAKFLILKIQDVMPAPADKIYKYVYFGGVAPILETSIHEVIEEMYGTEIAQANHIFLP

DSRKLNLYGLEVKSRGEILQKTEN

ALP7 gi|228905653|ref|ZP_04069581.1|hypothetical protein
bthur0014_66980 [*Bacillus thuringiensis* IBL 4222]

(SEQ ID NO: 14)

MMNKDSGNSLDMNLIDGFYIETPINVVEISKDEADSHFVATITNPKELLSRLLISTTIPGE

DTERFFLVGDEAGKHALANNHVNKLHDKITSPIPYVMFLSAVSFYHAINETRESDDNTV

EIEYFQTMLPIWLLKRTAKFSEAQNAMAERFAGEHEVTIHTPGMEKTLKITVEKATCRIE

GEIARLAIKKNFELEDREEARQFDNNDTVLVDIGGGTIDLVLSPAGLKSPKNRDSMQPID

KLSYLSHIEKLRKEKFLEKFSDLRSFETFIVNNFQKPKMELVDGNTGQRVDLTDKIRSSL

KEFAKFLILKIQDVMPAPADKVYKYVYFGGVAPILETSIHEVIEEMYGAEIAQANHIFLPD

SRKLNLYGLEVKSRGEMLQKTEK

Alp5 mamK [*Magnetospirillum gryphiswaldense*]

(SEQ ID NO: 15)

MWIDLLARERSDKMSEGEGQAKNRLFLGIDLGTSHTAVMTSRGKKFLLKSVVGYPKDV

IGLKLLGRPYVVGDEAFEMRSYLDLRYPLQDGVLSEISDRDIEVARHLLTHVVKSAEPG

ANDEICAVIGVPARASGANKALLLKMAQEVVHTALVVSEPFMVGYGLDKLNNTIIVDIG

AGTTDICALKGTVPGPEDQVTLTKAGNYLDERLQNAILERHPELQMNTNVACAVKEQF

SFVGARGEAATFEFRAAGKPVRCDVTESVKIACEALMPDIIESIEILLRSFQPEYQATVLQ

NIVFAGGGSRIRGLAAYVKDKLRPFGNADVTCVKDPTFDGCRGALRLAEELPPQYWCQ

LGDVSGQ

Alp5 [*Magnetospirillum magneticum* AMB-1]

(SEQ ID NO: 16)

MSEGEGQAKNRLFLGIDLGTSHTAVMSSRGKKFLLKSVVGYPKDVIGLKLLGRPYVVG

DEAFEMRSYLDIRYPLQDGVLSEISDRDIEVARHLLTHVVKSAEPGPNDEICAVIGVPAR

ASAANKALLLKMAQEVVHTALVVSEPFMVGYGLDKLINTIIVDIGAGTTDICALKGTVP

GPEDQVTLTKAGNYVDERLQNAILERHPELQMNVNVACAVKEQFSFVGTPTEVASFEF

RAAGKPVRADVTEPVKIACEALMPDIIESIETLLRSFQPEYQATVLQNIVFAGGGSRIRGL

AAYVKEKLRPFGDANVTCVKDPTFDGCRGALRLAEELPPQYWRQLGDVSGS

Alp5b [*Magnetospirillum magnetotacticum* MS-1]

(SEQ ID NO: 17)

MSSRGKKFLLKSVVGYPKDVIGLKLLGRPYVVGDEAFEMRSYLDIRYPLQDGVLSEISD

RDIEVARHLLTHVVKSAEPGPNDEICAVIGVPARASAANKALLLKMAQEVVHTALVVSE

PFMVGYGLDKLINTIIVDIGAGTTDICALKGTVPGPEDQVTLTKAGNYVDERLQNAILER

HPELQMNVNVACAVKEQFSFVGTPTEVASFEFRAAGKPVRADVTEPVKIACEALMPDII

ESIETLLRSFQPEYQATVLQNIVFAGGGSRIRGLAAYVKEKLRPFGDANVTCVKDPTFDG

CRGALRLAEELPPQYWRQLGDVSGS

-continued

Alp5 [*Magnetococcus* sp. MC-1]
(SEQ ID NO: 18)
MQSPAGNDKQLFVGIDLGTSRTAIMTRRGVKTMVRSVVGYPKDIIGVKILNNTVVIGQE

ALDNQAYLNLYYPLADGVLKETSEKDEMAAKELLKYVISQAKPQGDEQILGIVGVPAR

TSIYNKSQLLKITDDLMSMSMVVSEPFMVAYGLDKLNNAIIIDIGAGTIDICAMKGTVPS

DKDQITLLKGGNYVDEVFTHAIAESYPDVQITSYIAQKIKEKHGFVGEPTEEVVVNLRAG

GKPMLHDVTRELRFACETIIPDILESVEKLVLSFDPDNQQEALKNIILAGGGSNLIGLDTV

LTEGLKEYGKVNVSRVADPDFAGAAGALKLATELPTEYWNQVGDIVGG

Alp5w [delta proteobacteriumMLMS-1]
(SEQ ID NO: 19)
MALADDEQVNDEINETASAIDDNPAPATDQPEFPAEVERPTPAGGGEQVTVGIDLGTCR

TVVITDHGQEFEIRSVVGYPKDVISRQAVGDGPIFGAEALDKRNFLELCSPLAEGVVREA

SERDYRAARELIHHLIDLVRAGNPGVRVNGVIGVPARASLMNKEVLLGVAREVMDRAL

VVSEPFMVAYALGRLNRAIIVDIGAGTVDICGVKGSLPAAEDQVTTFKGGDYLDERLEA

AIIRRHPGAQVTHSLACRLKEEHAFVGEPEKPVEVTLRVEGKPVQFDITDEMRTICESMV

PNIIEQLEVLIASFDPEDQEEVLRHIYLAGGGSRIRGLDAMIARGLREYGEVRVTRVDDPE

RIGAIGALKLAREIPTNQWAQVGLMFGG

Alp5 [deltaproteobacteriumMLMS-1]
(SEQ ID NO: 20)
MSETEAEDRPLLLGIDLGVARTAVVSNRGARHLLDSVVGYPRDIIALKTLGAPQIFGARA

LEHKAALTLYHPLGDGTIAQDRRRDYNAAGELLRHVIELATNSAPPRANVTDHGVHGV

SGHGGPQAAASETAMRTSVPEPARSPLSAVPRDRLRVSGVIAVPATFGAGGRQTLATIA

GELLADFLIIEQPLPVAYYLGRLDNSLLIDIGAGSISLCPCRGRLPNPNERVTLPKGGDSLD

QRLQALISQRYPEVQITRELARQIKEEHAHVGTSPRPVLVTLRAAGKPRQYELSEELRLV

CQGLVPEIAEKLAAIIHEFDPEDLDEVLQNIYLTGGGAQIHGLDTALADALADYGQVRIK

ILDDPEYAGALGALRLAEELPPQRWHDSGFT

Alp5b [delta proteobacteriumMLMS-1]
(SEQ ID NO: 21)
MSETEAEDRPLLLGIDLGVARTAVVSNRGARHLLDSVVGYPRDIIALKTLGAPQIFGARA

LEHKAALTLYHPLGDGTIAQDRRRDYNAAGELLRHVIELATNSAPPRANVTDHGVHGG

PQVAASESAMRTSVPEPARSPLSAVPRDRLRVSGVIAVPATFGAGGRQTLATIAGELLAD

FLIIEQPLPVAYYLGRLDNSLLIDIGAGSISLCPCRGRLPNPNERVILPKGGDSLDQRLQAL

ISQRYPEVQITRELARQIKEEHAHVGTSPRPVLVTLRAAGKPRQYELSEELRLVCQGLVP

EIAEKLAAIIHEFDPEDLDEVLQNIYLTGGGAHIHGLDTALADALADYGQVRIKILDDPEY

AGALGALRLAEELPPQRWHDSGFT

Alp5c [delta proteobacteriumMLMS-1]
(SEQ ID NO: 22)
MNKEVLLGVAREVMDRALVVSEPFMVAYALGRLNRAIIVDIGAGTVDICGVKGSLPAA

EDQVTTFKGGDYLDERLEAAIIRRHPGAQVTHSLACRLKEEHAFVGEPEKPVEVTLRVE

GKPVQFDITDEMRTICESMVPNIIEQLEVLIASFDPEDQEEVLRHIYLAGGGSRIRGLDAMI

ARGLREYGEVRVTRVDDPERIGAIGALKLAREIPTNQWAQVGLMFGG

Alp7 gp207gi|156564188 [*Bacillus* phage 0305phi8-36]
(SEQ ID NO: 23)
MYIFGCDIGFKQFKGINLEDDIEFKFPNIIGFPTSLEIQNATDHGETMKDLWLTYDDETYY

VGDKASEFATNHRYTFLANKVDTIDETVKLLTGLGLLYETGQNKIDLMVTGVPVEEYFL

VKDKIETEFVRDYDYSFRGRKCRSTIQKVVVVPQGAGDYYDYILDESGQVITERVKPKT

VIVNIGYRTTEIVTMNNGRFSRSESTTLYTATNNFHKELRRLLAKEYGIRKNLTQIDEIYR

ERKVYIKGIATDISELITSAIDMHVGSISGEIPVWVNPDDVHEILLTGGGSTGLTPFFQSQF

GDIILKHDNPEFGNARGFAKYGRLIAHG

Alp8 orf250 [*Proteus vulgaris*]
(SEQ ID NO: 24)

MELLRKGRSFGGLFLIKGKVMNQSERFIVGLDIGYSNVKVACGGTQLLDPKVTIFPAYA

TPEPESDLALAKKSPDEVKVYPNGTEWRVFTNRVGHRELHESYHSTEMYKALFYGALI

KATEGRSDVIDILVTGLPVRIANSEADRSQLCESFTGKHEVTPGRFILVKEVVVLSQGVGI

MNDILNTEGLISDEDLEFSNILVIDPGYYSMDYVTFHRGDKKNEFSGSSLNATSVIIEEIVR

VLERDYPKEGAQETERIETALRLGNKTFNNGFRSVEIEPLIEEVSHRIVSSVVAELLKRTR

SIGPVHIIISAGGGARFYDHFIKEAFPQARILQSVNPVASNSIGYWHYGVNKLSSQSD

Alp8 pCAR1_p156 [*Pseudomonas resinovorans*]
(SEQ ID NO: 25)

MQLQRLGFCRCGVSCVAGSSASSFGALLLSFFAGSGIRMGNALGLDIGYSNVIGVFGSG

DGQPESIIRPSQAAPLSVLPGDSGLRPGEVIVEVDGAPWVAFAAPGRVQDGRELHEDYTS

SHAYEALFKGALLHAAGDKDVIDCLVTGLPVSQARDKPYVEALIKRMTGTHRITPKREV

TVKRVEVVAQPIGTLTEIYCNSDASEVIEESVSIIIDPGFFSVDWVVFDHRELVVNSSSSSL

KAMSVVLEACNEEIAKDHGGIPGVEKIEHALQSGKSYILIYGRKVELAEYLERAAERVIP

SVFTEIKQGLRFLKGRAIDCVILGGGGASLYEPFARKEFPDALVVKPVNSVKSNAEGFW

HIARS

Alp8 pYR1_0185 [*Yersinia ruckeri*]
(SEQ ID NO: 26)

MSQFVLGLDIGYSNLKMAMGHKGEEARTVVMPVGAGPLELMPQQLTGGAGASI

QVVIDGEKWVAGVEPDRLQGWERELHGDYPSTNPYKALFYAALLMSEQKEIDVLVTGL

PVSQYMEVERREALKARLEGEHQITPKRSVAVKSVVVVPQPAGAYMDVVSSTKDEDLL

EIIQGGKTVVIDPGFFSVDWVALEEGEVRYHSSGTSLKAMSVLLQETDRLIQEDHGGAPG

IEKIEKAIRAGKAEIFLYGEKVSIKDYFKKASTKVAQNALIPMRKSMREDGMDADVVLL

AGGGAEAYQDAAKELFPKSRIVLPNESVASNARGFWFCG

Alp8 P91278ORF_129 [*Photobacterium damselae* subsp. *piscicida*]
(SEQ ID NO: 27)

MSQFVLGLDIGYSNLKMAMGYKGEEARTVVMPVGAGPLELMPQQLTGGAGTCIQVVI

DGEKWVAGVEPDRLQGWERELHGDYPSTNPYKALFYAALLMSEQKEIDVLVTGLPVSQ

YMDVERREALKSRLEGEHQITPKRSVAVKSVVVVPQPAGAYMDVVSSTKDEDLLEIIQG

GKTVVIDPGFFSVDWVALEEGEVRYHSSGTSLKAMSVLLQETDRLIQEDHGGAPGIEKIE

KAIRAGKAEIFLYGEKVSIKDYFKKASTKVAQNALIPMRKSMREDGMDADVVLLAGGG

AEAYQDAAKELFPKSRIVLPNESVASNARGFWFCG

Alp8 Sputw3181_1079 [*Shewanella sp.* W3-18-1]
(SEQ ID NO: 28)

MFVLGVDIGYSNLKLAIGQSGSEPKTIILPAGAGPADRMPERIGGGDDETCLYVSVDNER

WAAGVPAGRLQGWERELHPEYPTTKTYKALFHAALLMAETESIDLVVTGLPVSQFHEP

QRKSDLVQRLKGVHQVTPKRSITVHDVKVLPQPAGAYMDLVQTGGDLGLIEEGRVVVI

DPGFFSVDWVALEAGEIRYSSSGTSLQAMSVLLETIDKLISEDHGAKVGMDRLEKAMRT

GDLQVLLFGEKVDISPYLNAATKKVAPIALTAMRQSMRDESINADLVLIAGGGALAYKE

AAKEIFSRSKIIVPEQSVLANVRGFWFYGA

-continued

Alp8 [*Vibrio cholerae*]
(SEQ ID NO: 29)
MFVLGVDIGYSNLKLAIGQSGSEPKTIILPAGAGPADRMPERIGGGDDETCLYVSVDNER

WAAGVPAGRLQGWERELHPEYPTTKTYKALFHAALLMAETESIDLVVTGLPVSQFHEP

QRKSDLVQRLKGVHQVTPKRSITVHDVKVLPQPAGAYMDLVQTGGDLGLIEEGRVVVI

DPGFFSVDWVALEAGEIRYSSSGTSLQAMSVLLETIDKLISEDHGAKVGMDRLEKAMRT

GDLQVLLFGEKVDISPYLNAAMKKVAPVALTAMRQSMRDESINADLVLIAGGGAMAY

KEAAKEIFSRSKIIVPEQSVLANVRGFWFYGA

Alp8 [*Vibrio cholerae* B33]
(SEQ ID NO: 30)
MFVLGVDIGYSNLKLAIGQSGSEPKTIILPAGAGPADRMPERIGGGDDETCLYVSVDNER

WAAGVPAGRLQGWERELHPEYPTTKTYKALFHAALLMAETESIDLVVTGLPVSQFHEP

QRKSDLVQRLKGVHQVTPKRSITVHDVKVLPQPAGAYMDLVQTGGDLGLIEEGRVVVI

DPGFFSVDWVALEAGEIRYSSSGTSLQAMSVLLETIDKLISEDHGAKVGMDRLEKAMRT

GDLQVLLFGEKVDISPYLNAAMKKVAPVALTAMRQSMRDESINADLVLIAGGGALAYK

EAAKEIFSRSKIIVPEQSVLANVRGFWFYGA

Alp8 VchoM_02002592 [*Vibrio cholerae* MO10]
(SEQ ID NO: 31)
MFVLGVDIGYSNLKLAIGQSGSEPKTIILPAGAGPADRMPERIGGGDDETCLYVSVDNER

WAAGVPAGRLQGWERELHPEYPTTKTYKALFHAALLMAETESIDLVVTGLPVSQFHEP

QRKSDLVKRLKGVHQVTPKRSITVHDVKVLPQPAGAYMDLVQTGGDLGLIEEGRVVVI

DPGFFSVDWVALEAGEIRYSSSGTSLQAMSVLLETIDKLISEDHGAKVGMDRLEKAMRT

GDLQVLLFGEKVDISPYLNAAMKKVAPVALTAMRQSMRDESINADLVLIAGGGAMAY

KEAAKEIFSRSKIIVPEQSVLANVRGFWFYGA

Alp8b [*Vibrio cholerae* MZO-3]
(SEQ ID NO: 32)
MFVLGVDIGYSNLKLAIGQSGSEPKTIILPAGAGPADRMPERIGGGDDETCLYVSVDNER

WAAGVPAGRLQGWERELHPEYPTTKTYKALFHAALLMAETESIDLVVTGLPVSQFHEP

QRKSDLVKRLKGVHQVTPKRSITVHDVKVLPQPAGAYMDLVQTGRDLGLIEEGRVVVI

DPGFFSVDWVALEAGEIRYSSSGTSLQAMSVLLETIDKLISEDHGAKVGMDRLEKAMRT

GDLQVLLFGEKVDISPYLNAAMKKVAPVALTAMRQSMRDESINTDLVLIAGGGALAYK

EAAKEIFSRSKIIVPEQSVLANVRGFWFYGA

Alp8 ASA_P4G053 [*Aeromonas salmonicida* subsp. *salmonicida* A449]
(SEQ ID NO: 33)
MKQFILGLDIGYSNLKIAMGFKGGHVTTTVLPVGAGPLALMPQQLTGGEGNCIQIVIDDE

KWVAGVEPDRLQGWNRELHDDYPATKPYKALFYAALLLSEQKEIDVLVTGLPVSQFM

NPELREALKKRLEGEHQITLKRSVTVKSVVVVPQPAGAYMDIVSSTKDEGLLEVLREGK

TVVIDPGFFSVDWVALEEGEVRYHSSGTSLKAMSVLLKTINLLIQEEHGGSPGIDKIEKAI

RSGKNEILLFGQKVGLKEYLDRESFNVAQNALIQMRTSMREDGMDADVVLLAGGGAE

AYKAAAKARIQLRSATLAYAA

Alp9 gi|47564291|[*Bacillus cereus* G9241]
(SEQ ID NO: 34)
MKSLYAIDVGIGFTKRAYRQDVDSEVTIKSEASTLAPIPNHAESEDLTKVSFIDLDFAYY

MGNEAHQSDASFLPPFDEEIENYYESEQFKQQIFGCIAKDYKENVVLPLVVTGLPVTDFG

SQHEQLQRALKKETSVQIDGKFITITVENVLILQQPVALHAYFLKEGIIQEQDRILIIDGGF

RTLEMTDMKQNVILNHYETELGCSKPLKNIKNILQNHAGESNQLHINDMPNILEKGYGG

REENPQTSQVHTLIQKELDAHFQDVMRVLQEQFKLEQYDTIIWTGGIVDLHKKRIEKIQG

EISSFRMVDASKEAALHGYYMIGSQVFDDITNQSVYESKL

Alp9 gi|166981354BcerAH_03975 [*Bacillus cereus* AH187]
(SEQ ID NO: 35)
MKSLYAIDVGIGFTKRAYRQDVDSEVTIKSEASTLAPVPNHDESEDLTKVSFIDLDFAYY

MGNEAHQSDASLLPPFDEEIENYYESERFKQQIFGCIAKDYKENVVLPLVVTGLPVTCFG

SQHEQLQRALKKETSVQIDGKFITITVENALILQQPVALHAYFLKEGIIQERDRILIIDGGF

RTLEMTDMKQNVILNHYETELGCSKPLKNIKNIVQNHAGESNQLHINDMPNILEKGYGG

REEDPQTSQVHTLIQKELDAHFQDVMRVLQEQFKLDQYDTIIWTGGIVDLHKKRIEKIQG

EISSFRMVDASKEAALHGYYMIGSQVFDDITNQSVYESKL

Alp9 gi|118478456|BALH_2828 [*Bacillus thuringiensis* str. Al Hakam]
(SEQ ID NO: 36)
MKSLYAIDVGIGFTKRAYRQDEDSEVTVKSEASTLAPVPNHDESEDLTKVSFIDLDFAYY

MGNEAHQSDASFLPPFEEEIENYYESEQFKQQIFGCIAKDYKENVVLPLVVTGLPVTYFG

SQHEQLQRALKKETSVQIDGKFIHITVENALILQQPVALHAYFLKEGIIQERDRILIIDGGF

RTLEMTDMKQNVILNHYETELGCSKPLKNIKNILQNHAGESNQLHINDMPNILEKGYGG

REENPQASQVHTLIQKELDTHFQDVMCVLQEQFKLDQYDTIIWTGGIVDLHKKRIEKMQ

GEISSFRMVDASKEAALHGYYMIGSQVFDDITNQSVYESKL

Alp9 gi|42782222|BCE_3167 [*Bacillus cereus* ATCC 10987]
(SEQ ID NO: 37)
MKSLYAIDVGIGFTKRAYRQDVDSEVTIKSEASTLAPVPNHAESEDLTKVSFIDLDFAYY

MGNEAHQSDASFLPPFDEEIENYYESEQFKQQIFGCIAKDYKENVVLPLVVTGLPVTYFG

SQHEQLQRALKKETSVQIDGKFINITVENALILQQPVALHAYFLKEGIIQERDRILIIDGGF

RTLEMTDMKQNVILNHYETELGCSKPLKNIKNIVQNHAGESDHLHINDMPNILEKGYGD

REENPQTSQVHTLIQKELDTHFQDVIRVLQEQFKLDQYDTIIWTGGIVDLHKKRIEKMQD

EISSFRIVDASKEAALHGYYMIGSQVFDDITNQSAYESKL

Alp9 gi|52142376|BCZK2867 [*Bacillus cereus* E33L]
(SEQ ID NO: 38)
MKSLYAIDVGIGFTKRAYRQDEDSEVTVKSEASTLAPVPNHDESEDLTKVSFIDLDFAYY

MGNEAHQSDASFLPPFEEEIENYYESEQFKQQIFGCIAKDYKENVVLPLVVTGLPVTYFG

SQHEQLQRALKKETSVQIDGKFIHITVENALILQQPVALHAYFLKEGIIQERDRILIIDGGF

RTLEMTDMKQNVILNHYETELGCSKPLKNIKNIVQNHAGESSHLHINDMPNILEKGYGG

REEDPQTSQVDTLIQKELDAHFQDVMRVLQEQFKLDQYDTIIWTGGIVDLHKKRIEKMQ

GEISSFRMVDASKEAALHGYYMIGSQVFDDITNQSVYESKL

Alp9 BT9727_2923 [*B. thuringiensis* serovar *konkukian* str. 97-27]
(SEQ ID NO: 39)
MKSLYAIDVGIGFTKRAYRQDEDSEVTVKSEASTLAPVPNHDESEDLTKVSFIDLDFAYY

MGNEAHQSDASFLPPFEEEIENYYESEQFKQQIFGCIAKDYKENVVLPLVVTGLPVTYFG

SQHEQLQRALKKETSVQIDGKFIHITVENALILQQPVALHAYFLKEGIIQERDRILIIDGGF

RTVEMTDMKQNVILNHYETELGCSKPLKNIKNILQNHAGESNQLHINDMPNILEKGYGG

REENPQASQVDTLIQKELDTHFQDVMCVLQEQFKLDQYDTIIWTGGIVDLHKKRIEKMQ

GEISSFRMVDASKEAALHGYYMIGSQVFDDITNQSVYESKL

Alp9 BcerN_03595 gi|168153429|[*Bacillus cereus* NVH0597-99]
(SEQ ID NO: 40)
MKSLYAIDVGIGFTKRAYRQDEDSEVTVKSEASTLAPVPNHDESEDLTKVSFIDLDFAYY

MGNEAHQSDASFLPPFEEEIENYYESEQFKQQIFGCIAKDYKENVVLPLVVTGLPVTYFG

SQHEQLQRALKKETSVQIDGKFIHITVENALILQQPVALHAYFLKEGIIQERDRILIIDGGF

-continued

RTLEMTDMKQNVILNHYETELGCSKPLKNIKNILQNHAGESNQLHINDMPNILEKGYGG

REENPQASQVDTLIQKELDTHFQDVMCVLQEQFMLDQYDTIIWTGGIVDLHKKRIEKMQ

GEISSFRMVDASKEAALHGYYMIGSQVFDDITNQSVYESKL

Alp9 BA3174gi|30263107|[*Bacillus anthracis* str. Ames]
(SEQ ID NO: 41)
MKSLYAIDVGIGFTKRVYRQDEDSEVTVKSEASTLAPVPNHDESEDLTKVSFIDLDFAYY

MGNEAHQSDASFLPPFEEEIENYYESEQFKQQIFGCIAKDYKENVVLPLVVTGLPVTYFG

SQHEQLQRALKKETSVQIDGKFIHITVENALILQQPVALHAYFLKEGIIQERDRILIIDGGF

RTLEMTDMKQNVILNHYETELGCSKPLKNIKNIVQNHAGESDHLHINDMPNILEKGYGG

REEDPQTNQVHILIQKELDAHFQDVMRVLQEQFKLDQYDTIIWTGGIVDLHKKRIEKMQ

GEISSFRMVDASKEAALHGYYMIGSQVFDDITNQSVYESKL

Alp9 BcerAH1_07003gi|167935984|ref|ZP_02523059.1|hypothetical
protein [*Bacillus cereus* AH1134]
(SEQ ID NO: 42)
MKSLYAIDVGIGFTKRAYRQDVDSEVTIKSEAATLAPVPNHAESEDLTKVSFIDLDFAYY

MGNEAHQSDASFLPPFEEEIENYYESERFKQQIFGCIAKDYKENVVLPLVVTGLPVTCFG

SQHEQLQRALKKETSVQIDGKFIHITVENALILQQPIALHAYFLKEGIIQERDRILIIDGGFR

TLEMTDMKQNVILNHYETELGCSKPLKNIKNIVQNHEGESNQLHINDMPNILEKGYECR

EENHETSQVHTLIQKELDAHFQDVMRVLQEQFKLEQYNTIIWTGGIVDLHKKRIEKMQS

EISSFRMVDASKEAALHGYYIIGSQVFDDITNQSAYESKL

Alp9 BC3130gi|30021240|[*Bacillus cereus* ATCC 14579]
(SEQ ID NO: 43)
MKSLYAIDVGIGFTKRAYRQDVDSEMTIKSEASTLAPVPNHAESEDLTKVSFIDLDFAYY

MGNEAHQSDASFLPPFDEEIENYYESERFKQQIFGCIAKDYKENVVLPLVVTGLPVTCFG

SQHEQLQRALKKETSVQIDGKFIHITVENALILQQPVALHAYFLKEGIIQERDRILIIDGGF

RTVEMTDMKQNVILNHYEAELGCSKPLKNIKNIVQNHEGESNQLHINDMPNILEKGYEC

REENHETSQVHTLIQKELDAHFQDVMRVLQEQFKLEQYNTIIWTGGIVDLHKKRIEKMQ

SEISSFRMVDASKEAALHGYYIIGSQVFEDITNQSAYESKL

Alp9 BcerKBAB4_2902 gi|163940835|[*Bacillus weihenstephanensis*
KBAB4]
(SEQ ID NO: 44)
MKSLYAIDAGIGFTKRAYRQDVDSEMTIKSEASTLAPVPNHAESEDLTKVSFIDLDFAYY

MGNEAHQSDASFLPPFDEEIENYYESERFKQQIFGCIAKDYKENVVLPLVVTGLPVTCFG

SQHEQLQNVLKKETSVQIDGKFINITVENALILQQPVALHAYFLKEGIIQERDRILIIDGGF

RTLEMTDMKQNVILNHYETELGCSKPLKNIKNILQNHAGESNHLHINDIPKILEKGYGGR

EKNYQTSQVNTLIQKELDAHFQDVMRVLQEQFKLDQYDTIIWTGGIVDIHKKRIEKMQG

EISSFRMVDASKEAALHGYYIIGSQVFEDITNQSAYESKL

Alp9 BcerB_01640gi|168133594 [*Bacillus cereus* B4264]
(SEQ ID NO: 45)
MKSLYAIDVGIGFTKRAYRQDVDSEMTVKSEASTLAPVPNHAESEDLTKVSFIDLDFAY

YMGNEAHQSDASFLPPFDEEIENYYESERFKQQIFGCIAKDYKENVVLPLVVTGLPISCF

GSQHEQLQRALKKETSVQIDGKFIHIMVENALILQQPVALHAYFLKEGIIQERDRILIIDGG

FRTLEMTDMKQNLILNHYETELGCSKPLKNIKNIVQNHEGESNQLHINDMPNILEKGYEC

REENHETSQVHTLIQKELDAHFQDVMRVLQEQFKLEQYNTIIWTGGIVDLHKKRIEKMQ

SEISSFRMVDASKEAALHGYYIIGSQVFDDITNQSAYESKL

-continued

Alp9 BcerW_00980gi|167951567|BcerW_00980 [*Bacillus cereus* W]
(SEQ ID NO: 46)
MKSLYAIDVGIGFTKRAYRQDEDSEVTVKSEASTLAPVPNHDESEDLTKVSFIDLDFAYY

MGNEAHQSDASFLPPFEEEIENYYESEQFKQQIFGCIAKDYKENVVLPLVVTGLPVTYFG

SQHEQLQRALKKETSVQIDGKFIHITVENALILQQPVALHAYFLKEGIIQERDRILIIDGGF

RILEMTDMKQNVILNHYETELGCNKPLKNIKNIVQNHAGESNQLHINDMPNILEKGYGG

REENPQASQIDTLIQKELDTHFQDVMCVLQEQFMLDQYDTIIWTGGIVDLHKKRIKKMQ

GEISSFRMVDASKEAALHGYYMIGSQVFDDITNQSVYESKL

Alp9 BcerA_10965gi|166993800|[*Bacillus cereus* AH820]
(SEQ ID NO: 47)
MKSLYAIDVGIGFTKRAYRQDEDSEVTVKSEASTLAPVPNHDESEDLTKVSFIDLDFAYY

MGNEADQSDASFLPPFEEEIENYYESEQFKQQIFGCIAKDYKENVVLPLVVTGLPVTYFG

SQHEQLQRALKKETSVQIDGKFIHITVENALILQQPVALHAYFLKEGIIQERDRILIIDGGF

RTLEMTNMKQNVILNHYETELGCNKPLKNIKNIVQNHAGESNQLHINDMPNILEKGYGG

REENPQASQIDTLIQKELDTHFQDVMCVLQEQFMLDQYDTIIWTGGIVDLHKKRIKKMQ

GEISSFRMVDASKEAALHGYYMIGSQVFDDITNQSVYESKL

Alp9 BcerG_10126gi|168140763|[*Bacillus cereus* G9842]
(SEQ ID NO: 48)
MKSLYAIDVGIGFTKRAYRQDVDSEMTIKSEASTLAPVPNHTDSEDLTKVSFIDLDFAYY

MGNEAHQSDASLLPPFNEEIENYYESERFKQQIFGCIAKDYKENVVLPLVVTGLPVTCFG

SQHEQLQHALKKETSVQIDGKFINITVENALILQQPVALHAYFLKEGIIQEQDRILIIDGGF

RTLEMADMKQNLILNHYETELGCSKPLKNIKNILQNHAGESNQLHINDMPKILEKGYGD

RDENYETSQVDILIQKELDAHFQDVMRVLQEQFKLDQYDTIIWTGGIVDIHKKRIEKMQ

GEIASFRMVDASKEAALHGYYIIGSQVFEDITNQSAYESKL

Alp9 RBTH_08102gi|75764516|[*Bacillus thuringiensis* serovar
israelensis ATCC 35646]
(SEQ ID NO: 49)
MKSLYAIDVGIGFTKRAYRQDVDSEMTIKSEASTLAPVPNHTDSEDLTKVSFIDLDFAYY

MGNEAHQSDASLLPPFNEEIENYYESERFKQQIFGCIAKDYKENVVLPLVVTGLPVTCFG

SQHEQLQHALKKETSVQIDGKFINITVENALILQQPVALHAYFLKEGIIQEQDRILIIDGGF

RTLEMADMKQNLILNHYETELGCSKPLKNIKNILQNHAGESNQLHINDMPKILEKGYGD

RDENYETSQVDILIQKELDAHFQDVMRVLQEQFKLDQYDTIIWTGGIVDIHKKRIEKMQ

GEIASFRMVDASKEAALHGYYIIGSQVFEDITNQSAQKSQL

Alp9 Bant_01003833gi|65320431|[*Bacillus anthracis* str. A2012]
(SEQ ID NO: 50)
MKSLYAIDVGIGFTKRVYRQDEDSEVTVKSEASTLAPVPNHDESEDLTKVSFIDLDFAYY

MGNEAHQSDASFLPPFEEEIENYYESEQFKQQIFGCIAKDYKENVVLPLVVTGLPVTYFG

SQHEQLQRALKKETSVQIDGKFIHITVENALILQQPVALHAYFLKEGIIQERDRILIIDGGF

RTLEMTDMKQNVILNHYETELGCSKPLKNIKNIVQNHAGESDHLHINDMPNILEKGYGG

REEDPQTNQVHILIQKERMHTSKTLCVYYKNNLS

Alp9 Bcer0_30068gi|168170327|[*Bacillus cereus* 03BB108]
(SEQ ID NO: 51)
MLLGNPYAIDLGNGFTKRASKKNKSLEADVITELSVLAPVDDYYNEASFTKIELTNTDFP

YYIGEEARKSKLPLIRALGENKAKRYEDPTFKKQLFGFIAKDFKKNVTIPLLVTGLPVSHF

GNQRESIQKVAMEETAVKVNGELITIKVKQCLVIPQPVGTQYYLVKKEIINKEDRILIIDG

-continued

```
GFGTFDVTDMSGNAVIDRLGTELGCEKAFMSIEQIVRDNIGETPDLSVSNMHYILENGYK

YNGSLYDLYTHKDVAEQVDAELQRHFDAALREVSQKFNLAVYDKIVWTGGMAALHK

KRIEKKKEQFPTFAVLENGQEANLLGYYYLGCDVFDKLTKEKASN

Alp10 Bcer98_3741gi|152977413|ref|YP_001376930.1|hypothetical
protein Bcer98_3741 [Bacillus cereus subsp. cytotoxis NVH 391-98]
                                                 (SEQ ID NO: 52)
MSGGKMKLKTYKVEGTEYVWGDDIIKVNNTLNTYAQQNRYKTNQYKTLSKIALAEMA

AKTNVKSYDEILVITGVPSEEIGTKAVDEIKEVYQGAHDLEVNGKKVSINVVDVIVLAQP

VGTVMSRYLDEDGFVADDTYEDMTVGIIDIGTGTTDLDVISMLRREKESTSVPKGMHDV

YEPIVAKIKKETSATINDYKLEKVFEEGAYQASKRMDPIDFNDEKTASIKEVYDFIVNGV

NNAWKTFDRFDEVLVSDGGANTFHELLEEWIGKVTKLEESQTANVEGFYRYGKFEVGE

EDGE

Alp10 pSK41_p11 gi|32470396|[Staphylococcus aureus]
                                                 (SEQ ID NO: 53)
MSNVYVMALDFGNGFVKGKINDEKFVIPSRIGRKTNENNQLKGFVDNKLDVSEFIINGN

NDEVLLFGNDLDKTTNTGKDTASTNDRYDIKSFKDLVECSIGLLAREVPEEVVNVVIAT

GMPSNEIGTDKQAKFEKLLNKSRLIEIDGIAKTINVKGVKIVAQPMGTLLDLNMENGKVF

KAFTEGKYSVLDFGSGTTIIDTYQNMKRVEEESFVINKGTIDFYKRIASHVSKKSEGASIT

PRMIEKGLEYKQCKLNQKTVIDFKDEFYKEQDSLIEEVMSNFEITVGNINSIDRIIVTGGG

ANIHFDSLSHYYSDVFEKADDSQFSNVRGYEKLGELLKNKVEQESK

Alp11 gi|169192559|[Natranaerobius thermophilus JW/NM-WN-LF]
                                                 (SEQ ID NO: 54)
MVWGSIPDKDRKRRRFSDGISEEDEVISEEEEHHLGGDDAFDRSVKNVGIDLGYGYVKF

IDGKEPKMFPSVVGYGNSQKYKSALQLDLNPLDDLQIKIGDEHFFIGDLAIRQSEVASRS

LGKDRSQDKNARVLMLTALSLLSSWDKQGFNLVTGLPTNFYAAFAEEWESTLNGEFKT

KMKIGGKTQERSFQIEEVTTLPQPFGTLYDQVLNSVGKVVDRDLTDSKIGIVDIGFKTTD

LAVSDGMEFINPLSFSTTTGLSNVNRLVNEKLRHEFKIDREEHQLDDCINSQKIMVAGKS

EDISSWVREALQTVSDKISVEIESKWDYRDFDTLLLTGGGGEMLYPYLKDKFPNLVLVE

DPQTANVRGYQKLANNLFNA

Alp11 gi|51894421|STH3287 Symbiobacterium thermophilum IAM 14863]
                                                 (SEQ ID NO: 55)
MERLIGVDLGYGFVKATDGREGYLFPSVVGDGSPYLPLRLASQETDPTDNLRVQIGDRV

YHVGTLAVRQSRMAYGFLSVMRDEGNDLLVLFLTALSLFASEANTTFSVVTGLPPGRM

HLADQFVRSVRGDHRVVRYRTGNPEELYLRVDRVTVVPQPLGTYWSQVLDARGQLAQ

QHPAADARVGIVDIGFRTTDLVTVEGGEYVPEQSRTVPTGLSAAYGAVANALLREYGIE

RENHALDEAIISGEIGVSGRRVDITGLREKAFEQLATKVLVEIRSTWQVADYDFLWFTGG

GGLALQRYLVPQFSQASLIADPLTANSREYLAWAHYIYGTGGAPWLERTPVNPQPRQG

Alp11 gi|121998776|Hhal_1997 [Halorhodospira halophila SL1]
                                                 (SEQ ID NO: 56)
MERCIGLDMGYGFIKIDDGREGHVFPSVVGEGESGMPMSLGVAQRSGSSELRITYGGKS

YLLGDYAIRHSRLAHRGLSPTRAEGDDLKILFLGALSLYARETVNNFHVVTGLPPGRMH

MADDLVRQLRGDHEVIRHVGASRFGVSIRLEQIEVVPQPVGSFWAEVLDDRGQIRGDHP

LLNGRVGIMDIGFRTSDFATVIDGEYSPGFCKTVPLGISFGYEEIAQELSTQYGLEREQYT

LDEAIIQGQVNVNGRPVDIVELRDRIFGDIATKLLVEARSMWQIQEYDHIIITGGGRVLE

RYLRPELSQAQLAQDSVTANARGYFNWAYFNAQQRAAEMGHATEQSSAEDYSSGSYG

TGSTTYSRGGDDGRDSAAVPQSRSGSEG
```

-continued

Alp11 gi|163722043|DalkDRAFT_4665 [*Desulfatibacillum alkenivorans* AK-01]
(SEQ ID NO: 57)
MDVLGIDIGFGFTKATNGKEFLMFKSLLGEAAEIPFRANLANSSFTENLHVTVDEQTFFV

GDFAERQSGVRQSTLDQDLLVQEFAKVLALTAAGIFSEKYAPMNVVSGLPVGYFTEYK

EAFVKAILGHHTVNYHKADGSVVTRRININRVRMIPQPMGSVLNLLMDERGRITDRDLA

NKKVGVVDVGFKTTDFIIFDKLQFITRGSRTIDTGISDIFRTIANKLRKQVDVSLELYRLY

DPVSKGSIRIRGQELELAEIRDHVYAQAAGEIADEINQIWADDWDMDTVVLTGGGME

LAKHLQPLIAGNVVGIPNDVDARLNNVQGYLKFARHLWEKDEPPPAREESAE

Alp12 gi|167036475|[*Thermoanaerobacter pseudethanolicus* ATCC 33223]
(SEQ ID NO: 58)
MFKIGLDLGYGYTKGINETGRMVLFPSLVGNAYQRNLIGLFGQNLNNLIENMHVVLRN

GKEEQEEYFIGDLARREGRNVSYAFDENKINHPNTKAVLASASALLFPSNDEPVHIVSGL

PLEQYIHQKDELRDMLKNFKAIVEFKGYNILKIVKFDRVTVFPQAAGAVYYAIMDDLQK

YLIKGSYIGLIDIGYRTTDYIVFVVDGKLSLREDLSGTLDIGMSQLNNAADKLFTQKTGS

KLDIPELIQLVNEGSIFYRGKVLNFEKELNEVKLEISRVIQDRIKAVWGSKLDFFNTIFLAG

GGAVSLFDSLKNLYENTVLVKNSQFANAKGFLKVAELEEKKERDRE

Alp12 gi|169835030|[*Clostridium botulinum* A3 str. Loch Maree]

(SEQ ID NO: 59)

MNKYTIAIDLGYGQIKGINQDNKRVIFPSIISSGKDRSLDTFFNSIDNIVDNIHVKILDEYFN

EKEYFVGELAKRQPSNSSFINRDNKINSEENKVLLATALGLLIPNDLPNDTKIHIVTGLPL

EHFIKQKQALNDMLKDFEHTIKFVDHNFSRNIKFEESNITLFPQGAGAIFSKINNDISSLLI

KETFIGLIDVGFKTTDIVVFRINKDKEPVFEQEMSATLDGLGMINIYNTMDKAFTDNSRD

GSKLNTEQLMLLCEEGKIFFKGDYIDLKKDLIKARKTLSTNIINKADGLWGSRKNSFNSI

MIAGGGGKVLYNHLKLIEPNMCQLIDNPEFANAIGYLEFGKQFK

Alp12 gi|167036509|ref|Teth39_0078 [*Thermoanaerobacter pseudethanolicus* ATCC33223]

(SEQ ID NO: 60)

MFKVGLDLGYGYVKGINEKGKEVLFPSLVGNAYERVLSGLFGTDNNKADNMHVVIVN

ENKEEYFVGELARREGKNVSYAFDEDKIYHPNTRALLTASCLLLLPEEEVPVHIVTGLPL

EQYIHKKEEFKNMLKNFKVMAYFKGDEKVKTIKFEKVTIFPQAAGAVYHAVMADIQKY

LVKGSYIGLIDIGFKTTDYIVFMVEDKLILREDMSGTVEVGMSALNNTVDKIFTQRTGSKI

DVSELIRLISDGKIFYKGRELDFTKEIDAVRSEIARVMKDKIKLIWGSKLDFFNTVFLAGG

GAKELVEYMKDFYEKIVLVKNAQFANARGFLKVAELEEKKAVNVR

Alp12 gi|20808451|TTE2052 [*Thermoanaerobacter tengcongensis* MB4]

(SEQ ID NO: 61)

MNIGLDLGFGYVKGVNSQNKRIIFPSIVSIGFDRPLAGIFNTNDIIENLHVKIVDKDGENSY

YVGNLARREGFSNSFALDIDKYTEPEAKALLSTAIFLLTMNENEPINLVTGLPLKQFQAY

KKAFEEELKNYKALVSLPEYRLMKTVEFEKVTVFPQAAGAVYYALLEDLDKYLLSDSYI

VLIDIGFKTTDYIVFFVEDRPYFLADLSGTIDAGISKIFTAMEQIYTAKTGSNLDTGDFITIL

NKGSIYFKGKYIDFTEEITALKKELAKLIEKRIYTSLKGILDKVMVIFVAGGGGADLYPYL

KDVHTSVELVKDAQFANALGFLKVAEIQK

Alp13 [*Paenibacillus* sp. JDR-2]

(SEQ ID NO: 62)

MSILTIDGGGSTIKVYDGDQVRQFPSTISYDWRPRNIESKGQFDFEWEYNGEKGFAGTLA

QRESDCADSLKGDTKAHPEAALRVLLALHQYCPDPAPKIIVGQPIKTHTPDEKNAIKGM

```
LLNRRHDITVNGQRRIILIQRCEVAAEGVSAGLLIPVGGTIRVIDIGSGTVNFGTLIDRQFN

DLGSFTLSTGVETTRGGVAALAHQIARAARAAKWQPEEKVNLCGGGALVMLELLRPYF

PNVGVIPDPVTANVRAFHMIARKVYG

Alp13 [Natranaerobius thermophilus]
                                                        (SEQ ID NO: 63)
MIVAVDAGNYETKVVNSHGKYSFYSDIGEYRERKLNQKHGSDDMEWEYQGERGFAGS

LAKFESEYGGSMMGDSKYHRDGLLRVLLALHQYCDDNNFKIVVGQPISSHTQAEKQRI

KEMLEGDHILTVNGVKKTIRILNCQVAAEGASAFWIHPQGGCVRMLDIGSGTINAATILD

RRYVDKDSFTINFGANSNLTNDVKEMANAIIRKSHKWNKDDRVWLIGGIAEEIEPYLTG

HFKNLKVLKPNGLHSKWANVLGYYALASGLYE

Alp14 gi|113477981|Tery_4593 [Trichodesmium erythraeum IMS101]
                                                        (SEQ ID NO: 64)
MVIKQPAAAAMLTQKPSNINKKAILSADLGRTATKACVSRTQNGVVFIPSNVKQLSVDQ

VRAGNFESKPTDPLLDMWLEYQGYGYAVGQLAADFGANLFGDERSFAKSKIEDALVK

VLACAGYFQLKGEFSVVIGLPFYNQEQFEKEKAQIISQLESPHQMFYRGGEEVEIRINKV

WVMPEGYGSLLWTEANHGKEFQPQLPKLSLAIVDIGHQTTDFLMVDRFRFARAASKSE

PFAMSQFYEDVASKIEGADSQSLYLLEAVHKPEGQRSYRPKGATKPINLDGIIPELRKVF

AAKLCDRLIKWIPERVSDVILTGGGADFFREDLEKLLQEAGLKSHLAQPPREANALGQYI

YGEAQLAISK

Alp14 gi|23127403|Npun02004266 [Nostoc punctiforme PCC 73102]
                                                        (SEQ ID NO: 65)
MTDQPSAANPMNSAAIPMNRQPLASTTPINAVNNNPPTTTKSGGGSGKTILSVDLGRTST

KTCVSREPGSVVFVPANVKQMSIEQVRGGVFEARATDPLMDLWLEYQGNGYAVGQLA

ADFGANLGVGQSKVEAALVKVLASAGYFKLRDDISVVLGLPFLSLEQFEKEKAQLISQV

GGPHVLNFRGESISLNVSKVWVMPEGYGSLLWSEAQPKKSPSSPDFTKISVAIVDIGHQT

VDLLMVDNFRFARGASKSEDFGMNKFYELVSAEIEGADSQSLALISAVNKPRGERYYRP

KGASKPTNLDDFLPNLTEMFSREICSRVLAWLPERVTDVILTGGGGEFFWDDVQRLLKE

AKINAHLAAPSRQANALGQYIYGEAQLSSNRAARA

Alp14 gi|119493931|ref|ZP_01624493.1|hypothetical protein
L8106_27631 [Lyngbya sp. PCC 8106]
                                                        (SEQ ID NO: 66)
MQSNKQPVGQPAVGPNTIMNRQTTTTTTSSRRTILSVDLGRTSTKACVSRNPNEVVFIPS

NVAQLTVEKARGGGFESENTDPLLDLWLEYRGDGFAIGQLAADFGANLFGGNDTDSPS

KVNDALIKIFACAGYFKMKGDVEVILGLPFYSQEQFEREKEQIISLLMGPHVLLFRADQIT

IDIKSVRVMPEGYGSLIWCEAQKSKETPNFADLSVAIVDVGHQTTDFLTVDRFRFARGVS

QSEVFAMSKFYEEVATKIEGADSQSLYLLEAVHRPAGQRFYRPRGSAKPVNLDEIVPEL

RKKFAQELSSRLVEWLPERVTDVVLTGGGGEFFWEDLQPLLKQAQLRAHLAQPARKAN

ALGQFVYGEAQQVKR

Alp14 gi|17232583|all5091 [Nostoc sp. PCC 7120]
                                                        (SEQ ID NO: 67)
MFVPANVKQMSIEQVRGGVFEARATDPLMDLWLEYQGKGYAVGQLAADFGANLGVG

QSKVEDALIKVLASAGYFKLKDEISVVLGLPFLSLEQFEREKAQLTSQVTGPHVLNFRGE

SVSLNITKVWVMPEGYGSLLWSEAQPKKGGASPDFTKISTAIVDIGHQTIDLLMVDNFRF

ARGASKSEDFGMNKFYELVAAEIDGADSQSLALISAVNKPKGERFYRPKGASKPTNLDD

SLPNLIEQFSREICSRVLAWLPERVTDVIITGGGGEFFWEDVQRLLKDAQISAHLAAPSRQ

ANALGQYIYGEAQLSSNRAARA
```

-continued

Alp14 gi|75908582|ref|YP_322878.1|hypothetical protein Ava_2365 [*Anabaena variabilis* ATCC 29413]
(SEQ ID NO: 68)
MTDQPSAATPMNAAAIPLNRVSASTPINAAPANNKPNNGSSKSILSVDLGRTSTKTCVSR

EPNNVVFVPANVKQMSIEQVRGGVFEARATDPLMDLWLEYQGKGYAVGQLAADFGA

NLGVGQSKVEDALIKVLASAGYFKLKDEISVVLGLPFLSLEQFEREKAQLTSQVTGPHVL

NFRGESVSLNITKVWVMPEGYGSLLWSEAQPKKGGASPDFTKISTAIVDIGHQTIDLLMV

DNFRFARGASKSEDFGMNKFYELVAAEIDGADSQSLALISAVNKPKGERFYRPKGASKP

TNLDDSLPNLIEQFSREICSRVLAWLPERVTDVIITGGGEFFWEDVQRLLKDAQISAHLA

APSRQANALGQYIYGEAQLSSNRAARA

Alp14 gi|119511106|ref|ZP_01630224.1|hypothetical protein N9414_16841 [*Nodularia spumigena* CCY9414]
(SEQ ID NO: 69)
MTDQPSAATPMNAAAIPLNRAANIPINANPATNRPNLGGKTILSVDLGRTSTKTCISREP

ANVVFVPANVKKMSIEQVKGGVFEARATDPLMDLWLEYQGYGYAVGQLAADFGANL

GVGQSKVEDALIKVLSCACYFKLKDEISVIMGLPFLSLEQFEKEKAQLTSQVTGPHVFNF

RGESVSLNITKIWVMPEGYGSLLWSEAQPKTGGKVPDFTKISVAVVDIGHQTIDLLMVD

NFRFARGASQSEDFGMNKFYDMVAAEIDGADSQSLALITAVNKPKGERLYRPKGASKP

TNLDDFLPNLIEMFSRDICSRVLAWLPERVTDVIITGGGEFFWEDVQRLLKEAQINAHL

SAPSRQANALGQYIYGEAQLSVGRATRA

Alp14 gi|75812595|ref|YP_320214.1|hypothetical protein Ava_130315 [*Anabaena variabilis* ATCC 29413]
(SEQ ID NO: 70)
MIPLVFGALGMAVGAVAGAFTAHAAGEKNRQEAKHHKQIANELTNKYASLAEQYYEL

ADKNKKDVKKLTDQLALSEVEKDFLRLAVRLQQNLIFLMWEIDREPTVNALNSFQSAV

EQTNQVLSQLQEELIIVPDDYYTRTLTAIEVTKEINLIIPSDTDSTNILSVDLGRAFTKACIS

REPSSVVFIPANVKHIPFEQIFTGAIYKYSSIPTDPLMNLWLEYKGSGYAVGQLGAKLGA

NLGVGQSKVEDALAKILAAIGYFKLKDEISVVISLPFLCSEQFEIEKTELISIIAGPHIMKFR

GESVYFNITKVWVMPEGYGSLLWKEAQPKKRGDVPDFTKNSVAIIDIGYESTNIIMLNNF

CFVKDASKSEYFGMNKLYELIASEIEGADSQSLALISAITKPKEERFYRPKGASKAINLDD

FLPNLIECFSREICSRILAWLDEQEDWTMNRVTNLIITGGGGEIFWEDVQRLLKEARINAH

LAAPSRQANALGQYIYGEARLRKFNS

Alp15 pBMB67_042 [*Bacillus thuringiensis*]
(SEQ ID NO: 71)
MVEQMLSKNMLLGGFDTGNIKAKISFLNEKGNIESFAIPTVIAEAPPAKIDLKSAPSKKNDYVNEKD

EDIELLHVRIISNSLDGDARSRAWYVGAYAKDQEDRQEPTVDEMGKTEDKFSQKNKKLHLIPLFTSM

AVAAARIGKEEVSVPFSGGMPIEDYKLRGEEQILEMLYGEHTVEFLDGTYEGKKIKITINDGTMNVE

GVSSVLAILFDIVNGEIVEVEGMDAEIGESYAINDLGAGTSDNAFFEDGELNKKLSTNTDLGTNKYI

DEILKNIKERFMENEILKSFMTDEIESPFKTREDFIQRLVMPEVEKMIEDDTYKPTFSVKWGPVKEN

VTDIVMDGMLKYAEDQKASLMKFWFKTNADKNIVVGGGVLFGYAGLRDLKEQDGFILPKNIQESAYF

TSRSYLIANLLEQLNKEGVEA

Alp16 pE88_13 [*Clostridium tetani* E88]

(SEQ ID NO: 72)

MENITNEYVMTLDAGKYETKLIGKNKKGTTEDIKRVIFKTKIYNLEDGYIDIEGNSHKIEL

DGKEYLIGEQGVEDSSETSKTNLIHKLAAYTAITQVLDSNKNNKVQLVLACPLSVLRNA

KAKEEYRDYIKGNGEITVKVDDKEYSFEITDITIKAEGSGVLFLEQENFKNKNVAVIDFG

GLNMGFSLYRNCVVNPSERFIEEHGVKDLIIRVGDALTDLNNGNLITNEQAESALNNGY

-continued

MKKGGEIDTESSTVIKKVKEKFLKDAIKLIEKRGFKLDQLDSLIFIGGTTQKLKEQISKTY

PNNSIITNNSQWTTCEGLYKVAVAKYCIQ

Alp16 gi|168724430|CdifQCD-7_08576 [*Clostridium difficile* QCD-76w55]
(SEQ ID NO: 73)
MNEKIANKIIVVDPGKNAVKVVVFSNTYELLTHYMFPSKTQIKRTFSDIDGSSDFQFRAE

FEGSKYLIGEGVQSSYNFETTKNNIHHQLCVYTAIAKEVHSKNENVHVVVGYPSSDFSN

EIQREKYVDLIKSNEKIDIILNGSDKSFNISEFNVFPEGMALVPRMKFPKRKVRVIDIGGQ

NLNHRLYDEKGNTLESFSLDEAGINHLEEYLRTTLRKNINADMVDIDSINILEAIEKQKID

AISDDMINGYDSVASFIENTVLDFIDNKILNQLSSKNVFLYKRSHLIIFTGGGSITLKKYLE

ELLPNNIGNLYFSETATWDNCASYLIKDLTLKFKDSKISKIELANYTKKIVKAFNDLIIGIT

PSTEENLTEDEELINRKRKTVKQK

Alp17 gi|169193825|NtherDRAFT_1874 [*Natranaerobius thermophilus* JW/NM-WN-LF]
(SEQ ID NO: 74)
MSNNILNCEIDLGYWFSNLRTRKILGEKNIRLRSKVEFTTDALISGAGTYHFRHDDLKGV

VGEGASQHSLELDKTRDKAYKVLAYSLIALAIEKNKDQMERDKEFPIINLVTNYPLNIYN

GQTKEQFEEFLKTSDFIHVFVNREHKLFWLKNCTVFPQTVPVSYANPSAFKNQIKGIVDI

GGMTTQGVILDSFNIIPSSRFTENLGCLNLYNKVRKALNSYFTVNIQDYEMPTIIKNGLRV

NTKKSLEIIDEIIRDHIKEIQNAMTVNNWNEENIPIMFTGGGSLLLREYLEEMFPHVEFSQ

DPLWDNAKGLRKVGEIFYGRQN

Alp18 gi|121593973|Ajs_1600 [*Acidovorax* sp. JS42]
(SEQ ID NO: 75)
MELIVRAVDVGSGNTKFVTGVTGTEIRCASFPSIAYPSSGETPQWPASERRKTVCIPVGPL

FYEVGPDVGLAADTFRAKQLHDEYTESPEYMALLRGALSMMKVPHIDLLIVGLPVALFI

LKKAALEKAVVGSHQVGGGKTVTVAKAMAVAQPQGALVHYAAEHQKIETIGTEQSLV

IDPGSRTFDWLVTRGMRLVQKQSHSINRGMSDVLRLLAAEISKDIGTPYRDFDAIDLALR

TGKAPVIFQKPYDMKKHLPLAESVAQQAVSTMRQWIETPESLQNIILVGGGAFLFKKAV

KAAFPKRHIHEVKEPMFANVRGFQIAGHNYAASAMASGRDRGAGEAV

Alp18 gi|91790780|Bpro_4960 [*Polaromonas* sp. JS666]
(SEQ ID NO: 76)
MKPETPMVDVRAVDVGYFSTKLTLARNLEGNASTIASMKPETPVVVDVRAVDIGYFST

KLTLGRKLVGNASTIATALFPSLAPRLPASMSMQTALHGKPDGSVVDVDDVNYFVGRD

AILYSSGREPREVLADYSMTDKYHALMRGAFHYIAQDAKATSELVIRHLVMGLPLNTFG

ENRDRLAARATGEHLLPDPSNPGSMRRITVEKASVIVQPQGALVSYGTTHREIFKEGWV

LVVDPGGGTLDWYVARGRLPNWQRSGAYPKSMLACAYAVADRIDPTWRDNFEIIERID

KAIRDKAPSFMTAGNTYELAPYTSAIEAVLKESTDKMVARLGSLDNLDLILFTGGGAKV

YFDFFKSRNPKLTNIMFMDDDPVFSNVKGFHVAGEIMSKSRTI

Alp18 gi|153886906|[*Ralstonia pickettii* 12D]
(SEQ ID NO: 77)
MSKSTPAIVRAIDVGYGNTKYTLSQRNIDMDAEVGLFPSLAPRATQSDFTGGLMAKADR

IVVQVDGESYSVGMDALAESKGIYKREVASAYSTSRAYRALFLGALQKMRLTAIDYMV

VGLPLTTYDRYAKELTELLTGTHEVPNPMALDQALKVTVRRVKVFPQPSGAFYNYAVP

RKLLQSMSQQTNLVLDPGYGTLDWFVTEGAKPLTGRCSATPKSVWAVISAVADHIGPD

LTSNPRTMSRIDNALRTGAPLTINGKTIDISPFKPIVDQIVADAINDMLMSIGNLSDIDNILI

TGGGAHLFVDHVKKELGKTHSQIHVDTDPVYSNVRGFQYAGEFWAGMDRQRAAA

-continued

Alp18 gi|89885972|Rfer_4487 [*Rhodoferax ferrireducens* T118]
(SEQ ID NO: 78)
MGLFPERLYQTARIEQVQHTTVFMSKTPPTFRALDLGFGFTKFSKGHYLQDGSLEVSAFP

SYAAAAVNFSIGAGVMTDLSIVKVSVDDEHFLVGEDVRNAADGVGRQMLESTFFTSSQ

YIALARGAMGFMNVPNHGEVDSLVMGLPLNIFRDQSIVDHVEAAMKGTHLVPDITKNS

GVERTILVKNVSIIPQVVGSLVAMSRDAGLMQKVNEQHNLTIDVGYGTLLWLVSDGFTP

VPARSNGNMGGVSSLLQKIIRSIDPSAVSSINIMDRLDKALLEDKASILINGAEVEVAKYH

RQLASAARENLTEMIRSIGTKADIDNVFLTGGGAHLYKDAIAAVFPGRQVHIASKGSRFT

NVRGFQFLAETED

Alp18 gi|56550594|RMe0036 [*Ralstonia metallidurans* CH34]
(SEQ ID NO: 79)
MKQQNELIKHPTIAIDVGYGNTKTAWAMGAEIATNMFPSLAPLAANSSLNAFGGGVFK

GRNVLNVEVDGARYEVGPGVSISGAHVHTGRSLSEDFATTAGYAALLAGALHYAGARE

VDRLVLGLPVHNTQKYAAHLKERFAGTHNFGWGDIHVGSVLPLPQPLGTLIHYIQQRGK

QYDPDNSYLVIDVGYFTTDWVVARGYTVDDTRSGGVPGGAARIYQQVASLITADRNQP

DVGIERIDQAIRDAKPLVYFGEDLDMGPYLSEAMALTNQPVKEIQTRVGRTDDLRAIILT

GGGAQLYAPAIRAAFPLNPIHMMDSPCFANVRGFYTIGAATRQASRAA

Alp18 g|171907839|Daro_2217 [*Dechloromonas aromatica* RCB]
(SEQ ID NO: 80)
MELIVRAVDVGSGNTKFVTAAAGTDIRCASFPSVAYPSSDDSPSWPASERKKTVCIPIGP

LFYEVGPDVSLAADTFRAKQLHDEYTETPEYMALLRGALSMMKVSHIDLLVVGLPVAL

FTVKKSALEKAMTGRHDIGNNKVVTVGKAMAVPQPQGALVHYASEHQKMVEIGNEQS

LIIDPGSRTFDWLVARGMRFVQKQSYSFNRGMSDVLRLLAAEITKDIGSPYRDYDAIDLA

LRTGKQPLIFQKPYDMKRLLPLAETVAEQAVSTMKEWIEAPHSLQNIILVGGGAFLFRKA

VKAAFPKHRIHEVKEPMFANVRGFQLAGQNYARSKMTATDRGQVQGASGELE

Alp18 gi|118699156|[*Burkholderia ambifaria* MC40-6]
(SEQ ID NO: 81)
MKTAVFAVDVGYGNTKYAHRAASGTIATGMFPSLTPLAASRTLSGYGESVLTARKVSTI

VIDQVEYEVGPDVPLTAAYGNTGRALADDYVLSDNYAALLFGAIHFSGVTHIERLVLGL

PVHNMKKYSAELKERFAGELDFGAGRVTVDKVVVIPQPLGSLVLASSNRQHEFGRDVA

HLVVDVGYFTTDWVYANGFTMDDNRSGGMPGGASQIYQRIASLVARDQGDEVEDIERI

DKALREQTPFFFYGTNIDLAPYLEQAQPLISGVVKEMQNNVGRLPNVRSIILSGGGAALY

AAVIRRAFPRVLIEVIDAPCLANVRGFLMVGEAGLARERR

ALP18 pRALTAgi|170938864|[*Cupriavidus taiwanensis*]
(SEQ ID NO: 82)
MNTTKTIAVDVGYGNTKFAFPLGADVATRMFLSLAPTRSASSLANHGDGYFQSRDVVH

VTVDGAEYEVGPDVSITSAYGNTGRTLSEDFVTTPEYAALLFGALHYSQARDVGQLILG

LPVHTLQKYAGVLQERFAGTHDFGAGSVSINRVVALPQPLGSLVTFMRQSGKDLDPDD

NCLIVDVGYFTTDWVVARGYMMDDTRSGGVPGGSSRIYQQVAQLLSADEGGEPSGSIE

RIDKSLRDGKLMRYYNKMVDLRPYFEVAKAQCQTAVKEMQTRVGRTEDIAAIVLTGG

GSALYSGAIRAAFPRSHIVAMESPCYANVRGFFDIGSARQARG

ALP18 gi|38637991|ref|NP_942965.1|hypothetical protein PHG330
[*Ralstonia eutropha* H16]
(SEQ ID NO: 83)
MSTNTIAVDVGYGNTKFAFPLGADVAASMFPSLAPTRSASSLASHGGGYFQARDVVHV

TVDGAEYEVGPDVSITSAYGNNGRTLSEDFVTTPEYAALLFGALHYSQARDVGQLILGL

PVHTLQKYAGALQERFTGAHDFGAGDVTIKRVVALPQPLGSLVTFMRQSGKELDPDDN

-continued

CLIVDVGYFTTDWVVARGYMMDDTRSGGVPGGSSRIYKQVATLLSADEGGEPTGDIERI

DKALRQGKLMRYYEKMVDLRPYFEVAKAQCQMAVKEMQTRVGRTEDIAAIVLTGGGS

ALYSGAIRAAFPRSHIVAMDSPCFANVRGFFDIGSARQARG

ALP18 gi|121530832|ref|ZP_01663440.1|conserved hypothetical protein
[*Ralstonia pickettii* 12J]
(SEQ ID NO: 84)
MKAATVAVDVGYGNTKFAFPMGSETKLNMFPSLAPQAAPRALANHGNGFFKARDVITI

AIDGVEYEVGPGVSLSSAYGQTGRTLSEDFVTKDEYAALLGGALRLAQVSEVGQLILGL

PVHTTQKYASYLRDRFTGTLDFGGEPVEIGSVICLPQPLGALVTFMRQQNTKFDADNAH

LVIDVGYFTTDWVVAQGFTMDDNRSGGVPGGSSKIYQQIASLIEQDEGEPVTGIERIDKC

LRDKKPMLFFDKEIDLTPYLEKARSVCQLAVKEIQTRVGRTEDIRAIILAGGGSALYVPAI

RAAFPRTPIHALSSPCFANVSGFYDIGSTRPVKQK

ALP18 gi|153887928|ref|ZP_02009075.1|conserved hypothetical protein
[*Ralstonia pickettii* 12D]
(SEQ ID NO: 85)
MKAATVAVDVGYGNTKFAFSMGSETKLNMFPSLAPQAAPRALANHGNGFFKARDVITI

AIDGVEYEVGPGVSLSSAYGQTGRTLSEDFVTKDEYAALLGGALRLAQVSEVGQLILGL

PVHTTQKYASYLRDRFTGTLDFGGEPVEIGSVICLPQPLGALVTFMRQQNTKFDADNAH

LVIDVGYFTTDWVVAQGFTMDDNRSGGVPGGSSKIYQQIASLIEQDEGEPVTGIERIDKC

LRDKKPMLFFDKEIDLTPYLEKARSVCQLAVKEIQTRVGRTEDIRAIILAGGGSALYVPAI

RAAFPRTPIHALSSPCFANVSGFYDIGSTRPVKQK

ALP18 gi|171320986|ref|ZP_02909976.1|conserved hypothetical protein
[*Burkholderia ambifaria* MEX-5]
(SEQ ID NO: 86)
MKTAVFAIDVGYGNTKYAHRAANNAVASGMFPSLAPLAASRSIAGYGDSVLTARKVA

TIVIDQVEYEVGPDVSLTAAYGNTGRALADDYIRTNNYAALLLGAIHFSGVTHIERLVLG

LPVHNLKKYAGALMERFTGTLDFGAGRVKIDKVMVIPQPLGSLVLASSNRKGGFGRDV

EHLVVDVGYFTTDWVYASGFAMDDKRSGGMPGGASQIYQRIAQLIARDQGDAVEDIER

IDKALREQTPFFFYGNDIDLAPYLEKAQPLISGVVKEMQNNVGRLANVRSIILSGGGAAL

YASVIRQAFPRVVIEVIDAPCLANVRGFLLVGESSVARERR

ALP18 CHROM3gi|161522610|Bmul_5577 [*Burkholderia multivorans* ATCC
17616]
(SEQ ID NO: 87)
MKTAVFAIDVGYGNTKYAYRAATNAVVSGMFPSLAPLAASRSIAGYGESVLTARKVAT

IVIDQVEYEVGPDVSLTAAYGNTGRALADDYVLSANYAGLLFGAIHFAGVDHIERLVLG

LPVHNMKKYSAELKERFTGELNFGAGRVTIDKVMVIPQPLGSLVLASSNRQGGFGRDVE

HLVVDVGYFTTDWVYANGFTMDDKRSGGMPGGASQIYQRIAALIARDQGDEVEDIERI

DKALREQTPFFFYGSNIDLAPYLEMAQPLISGVVKEMQNNVGRLANVRSIILSGGGAAL

YAGVIRRAFPRVVIEVIDAPCLANVRGFLLVGESSLARERR

ALP18 pBVIE02gi|134287584|Bcep1808_7086 [*Burkholderia vietnamiensis* G4]
(SEQ ID NO: 88)
MFPSLAPLAASRSIAGYGESVLTARKVATIVIDQVEYEVGPDVSLTAAYGNTGRALADD

YVLSANYAALLFGAIHFAGVDHIERLVLGLPVHNMKKYAAELKERFTGELDFGAGRVKI

DKVMVIPQPLGSLVLASSNRPGGFGRDVEHLVVDVGYFTTDWVYANGFTMDDKRSGG

MPGGASQIYQRIAALIARDQGDEVEDIERIDKALREKTPFFFYGTNVDLAPYLEMAQPLI

SGVVKEMQNNVGRLANVRSIILSGGGAALYAAVIRRAFPRVVIEVIDAPCLANVRGFLL

VGESSLARERR

-continued

ALP18 gi|71908146|ref|YP_285733.1|hypothetical protein Daro_2530
[*Dechloromonas aromatica* RCB]
(SEQ ID NO: 89)

MLAARKSIEEPHMDYIVRAVDVGFGNTKYVSNVVGSDIRCTNFPSVAYPSMREPSGQPG

YERRKTVAIPVNGLFYEVGPEVELAADTFRATQMHDRYTETPEYTALLRGALALMKQP

EIDLLVVGLPVAALTTKKTALEKAVTGTHDIGNGKNVVVRKALAIAQPQGALVDFVEQ

HGKTTTIEREQSLILDPGSRTFDWLVARGMRLVQNKSHSVNRGVFDILQAIAAEIGHDIG

TPYNDIEAIDLALRTGKNPVIYQKPYDISRAMPMAHSIAQQAVASMMRWIDASYSFQNII

LVGGGAYLFKKAVKEAFPKHRILEVKDPLHANVRGFQIAGMNHVDKLFSGTATATHGGA

Alp19 gi|163937904|BcerKBAB4_5321 [*Bacillus weihenstephanensis* KBAB4]
(SEQ ID NO: 90)

MTVDYIGVESANSFVKVASANEELCYLNTLRRVESFEDTTGLTVYTYEGIRYVIGEAQGI

SSSARNDDRYSSAGYRTETILAISQLVKDGSEIVVGTGLPSEDYKNGDNHEKVKRNLVG

EHTVQIDGKTKTFSILRVYTPMQPIGSVVNRIYDYNLKVRKDMESERTARKLVIDIGFGT

TDVCEAEGLRIVRYDGVQVGMLEANRIIKDELSKRGARGIVSLLHMDTLLRNAKREYV

KDEFTDKEILSKVIIEIGGKEYEIKDLMEQALEYTARIVMQRVDNLGYVLKDYDVVLFTG

GSLLALHKYIKPYLTGVNTKAEQGAQTANVKGYTKYAMIQDAKAVAK

Alp20 gi|91791236|Bpro_5434 [*Polaromonas* sp. J5666]
(SEQ ID NO: 91)

MPEIVAIDLGYGHTKVVSQGRDGEIKRMIFPSVAPITTRERTAESNGMGALRTVTVCVG

ANNYVIGKDAYLEADSNYSRSRLDEYSQTDGYHALMLGALALSGLREIDQLVIGLPLTT

LDTYHSVMSSKYLGEHSIGATYARRKVELAVRNVLVTSQPAGAMINAVAGQPGLKKAT

NLAIDMGYFTMDFLMCEGLRPFYKRSGAVQGGMSGYYDHLNGMVAEKITSEGLPAQS

TVDHFRLEETLSNGIQGENGRTIYSLRIGKLEVDITECVERASTRLTEYLDRMMTTLGGG

SSMGIISSVVLAGGGARMILPAVKERFGKTHDIVMQDAAQYAIANGFLHFGLASAKRAA

AQV

Alp20 gi|117676207|ref|YP_863783.1|hypothetical protein Shewana3_4268
[*Shewanella* sp. ANA-3]
(SEQ ID NO: 92)

MNNPVIITVDVGYGTTTCVHKESLGNYSVKTFPSLPIPIKSDINLGLAGEERDVTNVEVD

GITYEVGSDVGTSVGSRNVRVLNTESFITSDRYKALLFGALSFLGKSNHIDIDVLVLGLPV

SVMFRKDELAKIYTGTHQITPSRKVTIRQVLVFEQPLGALMSFLRQGGNERFAQCKDKT

MLSIDPGYMTTDFITSKGLKVSPNRSGDSETGMSKVIGAVEVALRSQLEGFNIKQINPELI

DQAFISGELKLYGKAMKFPKCDLFDVTSAIRSVTDEALTSVVNKVGDGQDIDLIIVSGGA

AAVYLPSIQRAFPFHKIEVVDDSLTAVARGLQTAGEQFIRGAIARGDYQKLKAV

Alp21 gi|86475955|[*Clostridium perfringens*]
(SEQ ID NO: 93)

MLKLGIDLGNGYTKFKGSKFASKTKVGRLASLAGLGEKPKDIHEVGYKGTTYIVGDGE

VFTSPDRYFGLDYEICLLTAIGLSSKDIVIDANICVGLPIIYFMSETKVLLEKKLNELTEKD

SIKITINGQDKIIKINNARVFAEGAYVLDCMDTDNIITIDLGAGTVNITQWDNLIPISYDTIT

KSFNKLYRDIANHIKNTGRGVVTPAYIEANFGEDTITIDGKVVDITDTKQMISKYVSAIVS

NVYDICDVPQANKIQIFGGGAIATEEYWKDAFGKDRDGVSVLPNSQYTNSKIYQKAAEI

LK

Alp21 gi|168206394|[*Clostridium perfringens* E str. JGS1987]

(SEQ ID NO: 94)

MLKLGIDLGNGYTKFKGSKFASKTKVGRLASLAGLGEKPKDIHEVGYKGTTYIVGDGE

VFTSPDRYFGLDYEICLLTAIGLSSKEIVIDANICVGLPIIYFMSETKVLLEKKLNELTEKDS

IKITINGQDKIIKINNARVFAEGAYVLDCMDTDNIITIDLGAGTVNITQWDNLIPISYDTITK

-continued

SFNKLYRDIANHIKNTGRGVVTPAYIEANFGEDTITIDGKVVDITDTKQMISKYVSAIVSN

VYDICDVPQANKIQIFGGGAIATEEYWKNAFGKDRDGVSVLPNSQYTNSKIYQKAAEILK

Alp21 gi|168211010|[Clostridium perfringens B str. ATCC 3626]
(SEQ ID NO: 95)
MLKLGIDLGNGYTKFKGSKFASKTKVGRLASLAGLGEKPKDIHEVGYKGTTYIVGDGE

VFTSPDRYFGLDYEICLLTAIGLSSKDIVIDANICVGLPIIYFMSKTKVLLEKKLNELTEKD

SIKITINGQDKIIKINNARVFAEGAYVLDCMDTDNIITIDLGAGTVNITQWDNLIPISYDTIT

KSFNKLYRDIANHIKNTGRGVVTPAYIEAHFGEDTITIDGKVVDITDTKQMISKYVSAIVS

NVYDICDVPQANKIQIFGGGAIATEEYWKNAFGKDRDGVSVLPNSQYTNSKIYQKAAEI

LK

Alp21 gi|148245152|CKL_4044 [*Clostridium kluyveri* DSM 555]
(SEQ ID NO: 96)

MVILGLDNGYHFTKTSEGVMFSSTVRKGKDIDINADTIQTNIDGQDYVVGAPNGEYVAD

SNKIDSIVTEICTFTAIAKSFPENKLIDCNIVAGLPVSYYSKQKSDFKEKLLGYGNKKVKL

NKHNFQINIVGAEIYPQSAGVVFVNSKDVKSDDSLVVDIGGGTVDVSAFHGLRLTNMAT

YNLGMLVLYSKLAQKLNSEYECKFMDYELYDKLKKGYITSNKFGRIDLEILNDDIEEHT

NVILNNIKRDFNYNSMDNIFVIGGGGVELYDRIKQKFKNAILCDDAQFVNANAFELMGQ

MKFATK

Alp21 gi|169344353|ref|ZP_02865326.1|StbA protein [*Clostridium perfringens* C str. JGS1495]
(SEQ ID NO: 97)

MKILGLDNGYNYTKTSKNICILSTVEKGHDDYNNVLEMNFNGENYIIGEPTGQYIVDAN

KFKTEEGKELLRVTTLAAIGLSYPEESVIDVSIVAGLPVAFYADQKEELTKLIKGLDDSCI

EINKLGKKQIIKIDKVMVLPQACGIIIEKNKKNESSLVIDIGGGTWDIAQFTGLKLVEKAT

YEKGMLVLYSAIAQELNAKYYTKFETSDIQNIIDRKYFTVDGVKKGIEDIEEYIDNYVRKI

AATIKRDFDTTNIDNFYLIGGGAISLESYVKKYFPSIEVEKECQFTNVNSFKFMGELKLK

Alp21 gi|169344353|[*Clostridium perfringens* C str. JGS1495]
(SEQ ID NO: 98)

MKILGLDNGYNYTKTSKNICILSTVEKGHDDYNNVLEMNFNGENYIIGEPTGQYIVDAN

KFKTEEGKELLRVTTLAAIGLSYPEESVIDVSIVAGLPVAFYADQKEELTKLIKGLDDSCI

EINKLGKKQIIKIDKVMVLPQACGIIIEKNKKNESSLVIDIGGGTWDIAQFTGLKLVEKAT

YEKGMLVLYSAIAQELNAKYYTKFETSDIQNIIDRKYFTVDGVKKGIEDIEEYIDNYVRKI

AATIKRDFDTTNIDNFYLIGGGAISLESYVKKYFPSIEVEKECQFTNVNSFKFMGELKLK

Alp22 gi|134287988|[*Burkholderia vietnamiensis* G4]
(SEQ ID NO: 99)

MTKNAAVSEEVGNVVHLQPEGEVRFAGTDDGHDGIKIVTDDWRQIHVPSRITRGADLIS

LNDADDNVYEGPDGTLYAVSPTLPYFDTTFSDYALSDINLVLVHHALAKAGLGGQRVN

LVTGLPVGDYYVANRPNVDFISRKVAHLRENTVRNKNESVALATIVKHNVVSEAIAAFF

DLLLDREGNQRDDVAEMVATGGIAIVDIGGKTTDTAVVMNGGRDVDGKRSGTDPIGGL

SLNKAVENELKAEFSVTALNPAQVDRAVREGVLRLYGKDHDCRAIIDKQKSELAKQIIA

ATHRKMRDASDLERVFFVGGGALLLCDQLEELYQHAEFVEDPQFANARGMLKAAMFL

QPR

Alp22 gi|153930634|ref|YP_001393404.1|plasmid stability protein StbA family protein [*Yersinia pseudotuberculosis* IP 31758]
(SEQ ID NO: 100)

MFSIPSRASYDVSIINIEGNDKSFIFETHNNKKFTVDESVPSPLDTRNIAIPYPVSDLNRVLV

HAALINAGYAGKDVHINTGLPVSHYYKPSTEINQTLVEQKKANLMHPVRCGIDGSLPVA

-continued

NIIANEVCSEGVAAYVDQLLDADGNTTEQYEEMYNSVVGVVDIGGHTTDCAVLLPKMV

INMTRSGSSEVGVLNLYDGIKTAVAAKFGINSSSITKRQIESALNTGKIMISRQAIDVSDIV

NTEKTRLFDQIIMAINEVIGTDEDIEKLIFVGGGSIVFEDYLRDHYKSIIIPEHPEFANARGM

MKLVKYIPKSN

Alp22 gi|126640709|ref|YP_001083693.1|hypothetical protein A1S_0642 [*Acinetobacter baumannii* ATCC 17978]
(SEQ ID NO: 101)

MGKSFRLPSRVANGRTIIGDTDEVNKQIIHVNGKYFTVDEFTKEHIDTRTEDYPLSDANV

ALVHHALHQAFDGQYRKFKIATGLPLNRYYGGKDKAKNEKLIADKTQNLLINKDFNNP

TVYNLYEHDKKNDPLQILNHIVLSEGQCAYFDALMDDNGKRSSMYEDLWEGGCAIIDIG

GRTTDIAMINPRGGTMQASRCDTLDVGIITLKNKVSQNLKEFFGLSSNITDWRLSKALKT

GIYNHGGKDHDISKILNAAKVEITDQIENSIKVNVQDGQDLGAVLLVGGGSITLGDELLK

RFNYDNWHLVKQPEFANARGMYKCAKYISKL

Alp23 gi|168191642|ref|ZP_02625920.1|Predicted ATPase of HSP70 class [*Clostridium butyricum* 5521]
(SEQ ID NO: 102)

MQNYSISGIDIGHATCSTSNNVLFESKITETEPLNKASKLIIDNKELWLGEGNYDTTYRKV

DKKNYINFLYGALALSTDTVYNYIVLGLPLSQYKEDKAALTNLVLNNNEKSVIINGIQKP

LVIKDVEIYPEGVVTLDDEWEGIVVDIGGRTTDCAMVINERNRRKIINPISLPLGTINFQTD

LIKKINNKYSLDLQVNDAERILKNGLILDGEIIKDDSIEDMYNLFVDKLINQLQVEYSLRT

NFISLTGGGANLFYNSIRKQIGENSVSLQENSIYANSQAFGELGESIWQ

Alp24gi|58701065|[*Lactobacillus paracasei* subsp.] *paracasei*]

(SEQ ID NO: 103)

MEIFSLDLGNKQTKLKSSKSEYVLPSRYLNQADMPMSVGSSTTNNDLHIYSVPFSDDKY

VWGRDIDGLHLDEYLADTIMYGNRYNSEAFKLLANFALGLLASDFKIANNQVLEVVVT

AGLPTGDYADQERLRSLLKVLEGQHQVTIDDQIVTVRVRKVYILPQPIGTLYNELLDDQ

GFIKNKALLDEKVGIVDVGGGTILIDTILNFELSGKNRQQFNTGVNDLYEAIASRIEGDVS

LYQLEKELRHGNQQHQWSYRFSKNRQDDITELVGKESDRFTRRLVANVTSTLKNLDSID

TLFFTGGGANLINQKILKTTFTNAAIVKDTEVANVNGFYKYGLSQQVQEKEGK

Alp24 i|125623971|[*Lactococcus lactis* subsp. *cremoris* MG1363]

(SEQ ID NO: 104)

MNIFAIDLGNKRIKMKSERGEYSYPSSYLNAEQVVTGGLGSEIIEQNYHFQTIQDSTNSFI

WGPNLEVYNLPERMIDTYARSGRMKQKKTIRIFEFALGRLVMDFPEAFESPLVVHLMLG

LSITDMHQESDTIDMLKKLAVGQHQIIIGGRVVTIIIPSEEFLSIIPQYMGTVLNLAFDQDY

QRNRRFSDGRIGVIDIGGGTILINRSVALNPSPIGDERFEGIQNLIKEIGRRINSTKSFLIEEM

LRSVDSEGNYVYPPNSNVQDSKNVSPIVEGEIERYTRFTVAPLVTENFPDIEEVDFIVVTG

GGASLLAKEALKDEIGEEYFSRLLFLNESEFANVRGFYKGGYLKWHSSNEELAVEARRE

KPAELQESQTRDVIVPPIRNTETSMDRELLEAQQKLQALQSEIDGVQIEFEN

Alp25 gi|109645228|ref|ZP_01369148.1|hypothetical protein Dhaf_2439 [*Desulfitobacterium hafniense* DCB-2]

(SEQ ID NO: 105)

MFENDILVAGGDPGFGAIKLDAGDTKVLFPAVICKGNERIFSALGNGNVSRGTDEEMQI

GSLDVIVTNHSTGVSRHYFMGSLAESLNPNEAHYCWDEDKSTDEEATALLVVALAVAQ

KEPKANIYLGTGVPVKYYAALKDKYEAELKGTWSVAFRSGPFKGQTRQLTIIRSRVLPQ

SYGVFIKETLNEYGIPISPKLFNGYVVVIDPGFRTTDVATFYDGVMLDPPNSFSIEKGLKW

-continued

AYTGVAEQLKEMTINHANPIETDDKELDKVFRVNEGMYPWNNGAINLNPVMQDMLGQ

LGTDISREVKKSLKPMLGKIHTVLVAGKVGEMIFEHLQFENKVLIENPQFGNATGFRIMA

ANLVNNITKKANAAP

Alp25 gi|89894855|ref|YP_518342.1|hypothetical protein DSY2109
[*Desulfitobacterium hafniense* Y51]
(SEQ ID NO: 106)
MFENDILVAGGDPGFGAIKLDAGDTKVLFPAVICKGNERIFSALGNGNVSRGTDEEMQT

GSLDVIVTNHSTGVSRHYFMGSLAESLNPNEAHYCWDEDKSTDEEATALLVVALAVAQ

KEPKANIYLGTGVPVKYYAALKDKYEAELKGTWSVAFRSGPFKGQTRQLTIIRSRVLPQ

SYGVFIKETLNEYGIPISPKLFNGYVVVIDPGFRTTDVATFYDGVMLDPPNSFSIEKGLKW

AYTGVAEQLKEMTINHANPIETDDKELDKVFRVNEGMYPWNNGAINLNPVMQDMLGQ

LGTDISREVKKSLKPMLGKIHTVLVAGKVGEMIFEHLQFENKVLIENPQFGNATGFRIMA

ANLVNNITKKANAAP

Alp26 gi|168205970|ref|ZP_02631975.1|putative plasmid partitioning
protein [*Clostridium perfringens* E str. JGS1987]
(SEQ ID NO: 107)
MILGLDIGNITSIGVGDKEDFITESRLREFEELDDFSGNDIVEINDKKFIFNEGYFENNVVK

HEKENFINLLYYTIAKTLDKENSKENDVKIVIGVPAGQYNSEKERLKKVILNNQCKNIKI

NGESRTINIEDIFIAPEGYGAKVEALQAKKEKVKLLMVDIGGGTSDVALFDENGRFIGGK

SIKVGLLDLYKNVQEVLDLKYKLSVSLEDARKYFDGELDIRNEKFEVENTYKTEALNKL

VKFLINELRGLYPNISQYAICLCGGAAGRILPVFKKVYIQAEAITDIKANAKGFRKVGLA

KWQNQGK

Alp26 gi|169342450|ref|ZP_02863511.1|putative plasmid partitioning protein [*Clostridium perfringens* C str. JGS1495]

(SEQ ID NO: 108)

MILGLDIGNITSIGVGDKEDFITESRLREFEELDDFSGNDIVEINDKKFIFNEGYFENNVVK

HEKENFINLLYYTIAKTLDKENSKENDVKIVIGVPAGQYNSEKERLKKVILNNQCKNIKI

NGESRTINIEDIFIAPEGYGAKVEALQAKKEKVKLLMVDIGGGTSDAALFDENGRFIGGK

SIKVGLLDLYKNVQEVLDLKYKLSVSLEDARKYFDGELDIRNEKFEVENTYKTEALNKL

VKFLINELRGLYPNISQYAICLCGGAAGRILPVFKKVYIQAEAITDIKANAKGFRKVGLA

KWQNQGK

Alp26 gi|86450171|gb|ABC96280.1|possible plasmid partitioning protein [*Clostridium perfringens*]

(SEQ ID NO: 109)

MILGLDIGNITSIGVGDKEDFITESRLREFEELDDFSGNDIVEINDKKFIFNEGYFENNVVK

HEKENFINLLYYTIAKTLDKENSKENDVKIVIGVPAGQYNSEKERLKKVILNNQCKNIKI

NGESRTINIEDIFIAPEGYGAKVEALQAKKEKVKLLMVDIGGGTSDAALFDENGRFIGGK

SIKVGLLDLYKNVQEVLDLKYKLSVSLEDARKYFDGELDIRNEKFEVENTYKTEALNKL

VKFLINELRGLYPNISQYAICLCGGADGRILPVFKKVYIQAEAITDIKANAKGFRKVGLA

KWQNQGK

Alp27 gi|146296416|ref|YP_001180187.1|hypothetical protein Csac_1394 [*Caldicellulosiruptor saccharolyticus* DSM 8903]

(SEQ ID NO: 110)

MKCGIDVGFGFTKAASEKGKKVVFPSAVAKTFMTDVGLKPTSDYFVTYMNQTYAVGR

AATQCLITETSFSEERFSTDFSKLLVLTALMALECDREVELGLGLPLMLYPKLKEKVKDY

FEFSEEIIINSNGIAHSYHITRCEVFPQGVGALFSISSPVEDGIYCILDVGFRTTDVIVVEIRN

```
RNINPLLDMCFTVDKGMSLAIERLGLMIERKYGVSYDTSLLFDIHERSHISVRGRKIDIEA

HKKEVFTAIADDIVQSISRRLQRGFDTFDAVLVAGGGAFNVASVLQKEFENVYVLDDSQ

FANAKGYLTLLNLGV

Alp27 gi|146297649|ref|YP_001181420.1|hypothetical protein Csac_2658
[Caldicellulosiruptor saccharolyticus DSM 8903]
                                                      (SEQ ID NO: 111)
MLVLTALMALESDREVELGLGLPLMLYPKLKEKVKDYFEFLEEIIIDKNGVAHSYHIARC

EVFPQGVGALFSITSPVEDGIYCILDVGFRTTDVIVVEIKSKNINPLLDMCFTVDKGMSLA

VERLGLMIERKYGVSYDTSLLFDIHERTYISVRGRKIDIEPHKKEVFRAIADDIVQSISRRL

QRGFDTFDAVLASGGGAFTVASVLQKEFSNVQIVENSQFANAKGYLALLSLGL

Alp29 gi|88707200|ref|ZP_01104890.1|bacterial StbA plasmid stability
protein [gamma proteobacterium KT 71]
                                                      (SEQ ID NO: 112)
MDALAVGLDDGYAVTKVALATGQLFAVPSRGRIGSAKITAVNQNDTGIAEYMSGDEHI

AVGVDDFDATGFDDYPLSAVNRAIVQHALLAAGLSGRSIHAVSGLPVARFYHSDGQRR

DALIASKTKSLLAPVQPLDGRPPVSIACHDVIPEALAAWYDHVIIEDGTEWVRLDESAVE

APLAIVDIGGRTTDFVVVADEKLWHQSSGSITCGLLDLRGSVAEAICAVHDLDSLSDAG

VDQALTENTIRLFGKDHDVTAIVSKARQQIVLRIEQETRRRLGRGAELERVLFVGGGSVV

LADAIRHWFPNQAIAPHPAFANARGMLKYLRYVGLPSE

Alp29 gi|77164147|ref|YP_342672.1|hypothetical protein Noc_0623
[Nitrosococcus oceani ATCC 19707]
                                                      (SEQ ID NO: 113)
MTELTDEKTTDQRQASIADDPMQVVQVGLDDGYAYTKVALPDGRLVSVPSRARMGAA

GVTWIRDVEQRIFEYETAGTVYSVGAVDGEPTQFDEYPGSALNRVIVQHALQEAGLSGR

SLHLVTGLPVAAFYRGDGQQRRQAIQTKRDGLKLTVEPVVAKKSSTRQALKASIAFHEV

IPEALAAWYDFVIVTLDDGVTLDADRLNAPIAIVDIGGRTTDYVVVQDQGVVHGSSGSL

NRGMLDLKLRVANLIQERFDLHELGEQIISRAVDTNRLRLHGKDHDVSDMVMNAKREL

VERLYAETRRKLGLGVELDRILFVGGGSAALSSDIADWFPNQTIADHAAFANARGMLK

YLQFVCDDASKER

Alp29 gi|88706892|ref|ZP_01104591.1|bacterial StbA plasmid stability
protein [gamma proteobacterium KT 71]
                                                      (SEQ ID NO: 114)
MTERIDKKPTQADKTSQLTSDPMSVVQVGLDDGYAYTKVALADGRLFSAPSRARIGSA

GVTWIREQEQRIFEYETGGTVYSVGAVDGEATQFDEYPSSALNRVIVQHAFQQAGLSGR

SIHLVTGLPVSAYYRHDGQLRQQEIDRKCESLKLSVEPKPNSAKPGKSILSASVAFHEVIP

EALAAWYDHVIVTQADGVTLDGDRLSAPIAIVDIGGRTTDFVVVQDQGIVHGSSGSLNR

GMLNVKSRVADLIQQTFDMSELGEQSIARAVDSSRLRLHGKDHDISAMVAAAKRELVE

LLYAETRRKLGLGVELDQVLFVGGGSAALATDIANWFPNQTIPDHAAFANARGMLKYL

QYVCDDTAGGF

Alp29 gi|120536986|ref|YP_957044.1|StbA family protein [Marinobacter
aquaeolei VT8]
                                                      (SEQ ID NO: 115)
MKTKRRAIDNGYNHHKVAWVEDGKIKTIKYPAILGSSTEAMTELGGGYANMYESTSGE

RFVVDEHVSNRISLRTGDYGLTEGNRVLVNHGLRETGIKPDDEVMLVTSLPVRDFFSSD

GSRNEDLIAGQKESMMKPVKVVLNNTDDPVRVANIVRSDVVSEAVAAAFDFLVDNVG

ESAKPLHAPLAVLDFGGSTFDVVTLTKDLRIRHASSGTLKRGTMDIIEPLKRLLLKHAQE

MKIKVSEIPDWMINQVMATGKMPYFSYEDGKPKNTEMPVNDVIEAAAAETVSEIKAFV

KQKIANFSEYQAVLLVGGGSLLCRKLFRDWEELPQFIVMDEFANARGMLKLVSI
```

Alp29 gi|126667805|ref|ZP_01738772.1|hypothetical protein MELB17_09158
[*Marinobacter* sp. ELB17]
(SEQ ID NO: 116)
MKRPLSIAVDNGYYDHKVAYWDGDVIRTFKYPVVIGSKHEVMSTMDGQLVGMYETEG

VRLVVDPTINNKIPLRYDEYGSSKENRTLVSHGLYKAGVAGGQEVHLTTALPFRDFYNI

DGSLNRPLIDAQKANMLVPVSLVASSDGPLDPIANVTQSRVMSEGVAAVIDYLVRDNSG

QARKMRAPIAVMDFGGSTFEVVTVMPNMNIRHSSSDTMKRGTYDIRTSFAPMLADYLR

ELGFKMKHAADWMVTEAFETGSIEFPGVGIDAGNRVIPVKHIIEEAAKPIVNEIKKFTQA

KLPNMAEYEAILLVGGGLLTESLFEDWKEEFGLIVVDEYANARGMLKVALIA

Alp30 AAAgi|124514596|gb|EAY56108.1|conserved hypothetical protein
[*Leptospirillum* sp. Group II UBA]
(SEQ ID NO: 117)
MSKTKPVRSPEQEFSEEPVIDVGLDDGYAAIKLAWYGPDGTLRTHSVPSRARSGSLGVG

SLFGDSALSVGGYETEGERFTVSPGLEGEVTRFPDYNLSPLARVLAHHALIAAGFAGKQ

VRIASGLPLDRYFRDGKEGKRKDEHRIARKIESFARPVRRLDGTGTARIVSHSVFAQGLA

AVVDWLVEGTTIRSQKDPVGVVDIGGQTTDISVINPDFQANHGHLKTCDLGVLDVRDLL

GRRIQSSHDVDKISDSALDAALTTGATRIWGKDVSVQDELRDAIREIESRLANEILSVFGK

EASTLETILFVGGGSLVFRNLPTRFPNAAVVDCPEFANARGLLKALSLSGRS

Alp32 gi|167628732|ref|YP_001679231.1|hypothetical protein HM1_0615
[*Heliobacterium modesticaldum* Ice1]
(SEQ ID NO: 118)
MIKLGVDNGNYNTKSSEGMLYASGYTASDKEFITPDMQLFYEGRYYAIGERRMRFQQD

KTREPDTFMLTLPAIADAMKHAGTTSAEIALGVGLPIGSYGTQKEAFRRYFLRDNVSFLF

EGTSYRCRIAECKVFAQGHAALCRYYPQLKDYRSITLVDIGGYTVDILTLHDFRLDRSSC

ASLRMGTITLYSRIQDTLQRNDILLSDELITDAIRGDIQHADSKLIHAVVEQAVVAYCKEL

LNALRERGLDLRLPTVFAGGGAELLELMLRRSDINTVAVLNRFANADGYKLLMG

Alp32 gi|89897287|ref|YP_520774.1|hypothetical protein DSY4541
[*Desulfitobacterium hafniense* Y51]
(SEQ ID NO: 119)
MIKLGVDNGNYNTKSSEGMLYASGFSVSDKEFVTPEMQVYFEGKYYAVGERRMRFQQ

DKTKEQDAFILTLPAIADAMKKAGMTYGEINLGVGLPIDSYGMQKDAFRRYFLRDNLSF

RFEGEFYRCRIVECKVFAQGHAALCRYYSQLKNYRSITLVDIGGYTVDILTLHDFRLDRS

SCASLRMGTITLYSRIQDTLQRSGIILSDELITDAIRGESQHADSKLIGAVVEQAVAAYCK

ELFNALRERGLDLRLPTVFAGGGAELLKPMLYRDDLNAVAVLDRFANADGYKLLMG

Alp33 gi|85859495|*Syntrophus aciditrophicus* SB]
(SEQ ID NO: 120)
MQMNLGLDVGYGDVKAVYQREGILEMLKFPTAIAYAEREVGDLSAFAGGEEYEYRGR

KYFVGREALVGAFSTRSFEFMKRYSPLFVFKAVKKIHRRTGELVTDVAMGLPLSHYTEA

NLKELVPLLQRIEVGREVLELNARFYPQGLGVLADYRLSQAGDVNARTDRDMIILDIGF

NTVDVIVVERGRIVKGESDTLERHGVSKISLDLAREIKVRMQLDLSEQESKDVLRQGRIR

VYGAERDLAELVRESAEKYMDWLIQEVHSKWMARIQRAEKVIIAGGGAYYLQEHIPEE

YLPLVHVPDHPEYANARGFLKALDVESGK

Alp34 gi|134288378|rBcep1808_6851 [*Burkholderia vietnamiensis* G4]
(SEQ ID NO: 121)
MQNQTIIGLDVGRSAVKATAFASGMFYPLTFPSIVSPAIDLTDESTARKAEAETIVVAGR

RYFTGDTARLQGSAGTTVGLSHNWTSTPEYLALVGSTMKRFAAKGVPGLTDPLLVIGTP

ASLYGSQQEQLKAETLKIVQAEIRVLPQPMGAYCDFYLDKSGVPVKTHMQDDAGRKKS

```
WAVIEVGHFTTDFLLMLEGQYIERGASSCEGLNFAAEHLLRILNAKDIHSNLIECELAIRT

KTILQYGRDVDIAEEVAEAVSHVAQKIISKADSLLSTDVRKLHGVLLAGGGAPLLYDELS

KKWPHCMLLDNPRMAVANGFCRYGMGIALRRAMRSQQESVNV

Alp35 gi|118443715|ref|YP_879207.1|NT01CX_0741 [Clostridium novyi NT]
                                                       (SEQ ID NO: 122)
MSKGNNIVDSFSVQVIDDGYADTKSRGEDTNMIVTPSYVTSWRPSYNKDNDLQEEKIDK

LSRIEVKVNGSKYLVGQCAVKQDRNIQWNGAADKHDDTSFDILLKTHLSLLNKKPMSR

VKLVMGLPVSASLDKERIEKMKAKVLRQHNSALRLYGDKDFQNKIVKVEDLIIKAQPH

GTLCDLILDSSGNLTNKDLARKVNAISDIGGKTHNLYLVDALEPLSDFCDTKNSGMYIA

YMWIKNYIEQELHLNVSDGQIQYIVASGQIKGYDLTPVIQKAYRSLARKIILEIRTVWEN

AFPPIDNIIFTGGGATVLKPYLQEEFKNAMYLTRNQNASGLFKQGIRKWKRKAV

Alp35 gi|168187430|[Clostridium botulinum C str. Eklund]
                                                       (SEQ ID NO: 123)
MSKGNNIVDSFSVQVIDDGYADTKSRGEDTNMIVTPSYVTSWRPSYNKDNDLQEEKIDK

LSRIEVKVNGSKYLVGKCAVKQDRNIQWNGASDKHDDTSFDILLKTHLSLLTKKPISRV

KLVMGLPVTASLDKERIEKMKAKVLRQHNLGVRLYGEKEFQNKIVKVEDLIVKAQPHG

TLCDLILDSSGNLTNKDLARKVNAISDIGGKTHNLYLVDALEPLADFCDTKNSGMYIAY

MWIKNYIEQELHLNVSDGQIQYIVASGQIKGYDLTPVIQKAYRSLARKIVLEIRTVWENA

FPPIDNIIFTGGGATILKPYLQEEFKNAMYLTRNQNASGLFKQGIRKWKRKAV

Alp36 gi|150019823|[Clostridium beijerinckii NCIMB 8052]
                                                       (SEQ ID NO: 124)
MRISADIGYNTTNFIGHNIEGSFSSTVKEKMHELETAKYTVEYNNKTYLIGNDDGFTSIEH

SRDKDIIFHICLYTAIAATMSSTIDNNVRVITGLPAQFFAEQKNSLIKALENRRVFMKLNG

ENRSFTITKVIVFPQSAGLFLYDKSLVEKDTLVVDIGGGTLDIAYMSNGQFKEGRTYPLG

VNPTYDVLLQELTKYGVNYSNRMKAEQIIADKAIFVEGKEIDVSKDIDNVLSLRAGEIIN

AIKQAFPEQSKYSRFVFIGGGALLLKNYLKDYRVLDDAQMINVKTYDIIGKSKNV

Alp37 gi|83589213|Moth_0345 [Moorella thermoacetica ATCC 39073]
                                                       (SEQ ID NO: 125)
MLAIQTNPQPAALAIDVGFGYTKAVSSTGGKVIFPSVVAPAGSPDAFDRLDKSDTGYRV

RIKKGIDGLLEEWLVGELALKEGREVQYFQDWEKHSHPAHDAVLLAAAVLTWNWPRA

GSGIMGISNPALVVGLPVDVWRDELQREGLKKHLAGLAAEVSVNGNDPVRVTFSRVYV

YPQAAGAFLTVPDLPDSGIVALVDVGQKTTDSAAIEIVNGRQRLVKTMCFSINKGMAAL

VEAVREEFRRQTGAPLPPQQAWETVKSGSLWYRGKQIDMAPAIKKARSEIARAIADQVL

AGWGERADFVRKVYLAGGILDLPDLKNMFPAAAVLPGPQWANALGFLKVARGLAV

Alp37 gi|34298835|ref|YP_001112331.1|hypothetical protein Dred_0971
[Desulfotomaculum reducens MI-1]
                                                       (SEQ ID NO: 126)
MSKVVAIDFGYREIKGVNSEGLEIKFPTAMAPYVKHPTAEGLEEVVTVTKPGYEPEMYF

YGQKALDETGVGFTNDRDKHLHSGHDILMLAAARKLGYENGDTLVVGVPISYADQRE

ALKTQLERLHGDVSVDGGKPKRISFNDVLVLRQGIVVFGLIPDLPNGTLISFDIGEHTTDV

STVKFKNGVIEPNPSKCFSLEYGYSKVVEAIQKEFQSKAGSPVSGEQARAIAEEGYVIYK

LKKLDMTLEVLRAKEEIAKNIVKDAKKRLGEIADFAAGFYLCGGGADVLPLKELLPGAV

IVDNPQTANARAYLQLAMSE

Alp38 gi|167630473|HM1_2411 [Heliobacterium modesticaldum Ice1]
                                                       (SEQ ID NO: 127)
MNMHAARLRQLPGFEPGEGKNLTVGLDIGFGYVKVVAGNGRWALFPSIVGEGRELHIL

SGFGSNDPIDNLVVDVDGRRYFVGNLALRETEAELDIDPDKIFNIDFEVLVYTALALVSD
```

```
KSDQDVNIYLGLPINFYRTQKARFEDKLRAHQMSRFVKILGQDVRLIRIGNFEIFPQAGG

AIFNQILDFRSEVRTPRLARGKIGIIDGGTKTTDCIYMEDLKFVDQRSFSVNDGGTHKILM

DIRDFLMKNFDHYYPRLAEVDQMLRERKVEVKGKVYDLSSVIDASASRVARKIVREIAA

KWPNHMEFRAMILVGGGGYVMHPFLKEIFPDILLVQDEFEGEAVTGGWNVIQFANALG

FLKLAVMRYGEKK
```

Alp39 gi|160933403|ref|ZP_02080791.1|hypothetical protein CLOLEP_02249
[*Clostridium leptum* DSM 753]

(SEQ ID NO: 128)
```
MNKTMNIGIDHGYYAIKTRHFSFPAGISEYSHEPYTLQNTLEYGGKFFVCGTGRQPILRN

KMENENYYLLTLAAIAKEIQQRGAKTECSVTIAAGLPLAGFGREKKSFREYLRPSSQPVS

FQFEGIPYKVTIEDVKLFPQGYSALMIHPELLQNEPSVLLMDIGGWTVDLMRLDNNVPN

AATCRSLELGMIRCIDEVKEQVRRDVGLSVTDAQVERVLAGKPCSMDEDARGIIQKQGR

LYTERLLSAAMEAGFDLKAIPVVMLGGGAAVVKRNVAPQDGLCRVFALLDDRVNAEG

FERILGRLSGGVGKG
```

Alp40 gi|168697294|ref|ZP_02729571.1|[*Clostridium difficile* QCD-37x79]
(SEQ ID NO: 129)
```
MSKLGIDIGNYAVKTSTDDIFESKVTEVKNFGSDSDSIKIGNKTYYLGEGDEEINIVKYEK

ENFLPLLLGAICRNTDDEVIDLALGLPVKQFGGLRKDLIEKLQGKEYHVEFEKGNETTKR

DITIRSVQVFPEGVTGYLYYAKDIVDQIAGRDVVLVDIGGKTTDIALVQGNKATDPYSV

NVGTINIYDAIKKSLEMDERFLGKVEIKREKIQDYIDKGFYLNGEKQDIKKNIDASVGLF

KQIYNELKLNYPISTSAVVVMGGGAKLLGEAFKKNIPGIIVMSDVDKHVFANAKGYKK

MMK
```

Alp40 gi|168206996|ref|ZP_02633001.1|hypothetical protein AC3_A0270
[*Clostridium perfringens* E str. JGS1987]

(SEQ ID NO: 130)
```
MKIIGLDIGNAEVNTSEGVHFPSRVKIGVNNMNKDDIKVNFEGLDFTIGQGSNNIGLNKY

KNINFKISVLVGIAKSFKENDIECNVVIGCPIETFNKNKEIVKDIKGIIESWGKQTIVIEQGE

SKEIKVIDIKNVAIFCESGIVFKNRERFSKEKTLVVDIGGGTRDDSLWNGLDLVECKSND

KMGMINLYETIIKEVNRRNKSNLNFDDAKAMIGKKEYKINQEIVDISYIDIIIENFVTGFM

SEINQIFPFSNVDSIQFVGGGAILLKEYITRLIPKAEVPNNAEFLNAETYREVGELMWS
```

Alp41 gi|30262713|ref|NP_845090.1|BA2740 [*Bacillus anthracis-*
str. Ames]

(SEQ ID NO: 131)

MSILLKAGADAGNNGLKLMVKGQDPIFIPSIYALYIGEPTGLLDEGDVSLSELENHIDVTI

SSPSLMLNNVRYIVGEKVIQDQLKGTEVEKKSNKSTDELMVITILSGLAVSAMRQSPTSS

HINIRYDLSVALPMQLITQEIAAENAKRYMGNHKVVFHYPNGRDVTINISIEYCKCLPEG

ASGTWGIVYDEEGNVVKHKIECEQNKVSEIDFVDKTLLSFDIGAGTTEEVVSLGVNFRPQ

LSKGLSYGVKETLLQIITRWNRKYPTKTIDSITEFNQIYLNDKHPRNALLVEESQPALLGL

AARVATDIINKIDDMKDDPYVFIYGGGAVIIKNSLKMILKQKGRLTNVIFVDNPLFTNAR

GLLVYTCSPKYREHKQKELGFTNLTIS

Alp41 gi|166985867|ref|ZP_02257138.1|hypothetical protein BcerAH_25982 [*Bacillus cereus* AH187]

(SEQ ID NO: 132)

MAILKAGADAGNSGLKLNVLGLDPLFIPSIYSHHIGEATNILSDEDISIEELENNIDVTISSP

TLKANNMRYIIGQKVIDENIKGIEMEKKSDKSKDDLVLLVTLAGLAISAMKKHPNKNKI

DVTYDLSVALPVATITPQTAQGFVERYMNHHTVKFHHPSGREVVVNIQVEFCKCLPEGA

AGSWGIVYDEKGKTIKRKVETTEDKTTEIDFVDKTILSFDIGAGTTEEVVSHGVSFKHKM

-continued

SRGLPYGVKETLLDIIKVWNLNNKQKTIDSIAEFNAIYLDSEHPRHIRLKEASRGALLGLA

NRIATDIINKIDDMKDDPYVFIYGGGAAIVKESLQQILEQKGRLTNVIFLKDPLFVNARGL

LVYTCSPRFEELKEKALAPVGEK

Alp41 gi|168163020|ref|ZP_02598253.1|hypothetical protein BcerH_23221
[*Bacillus cereus* H3081.97]
(SEQ ID NO: 133)
MSNVKEKEDFLREDEELEMLTKAYKMDSAFDVGNANVKAKINGKVLKQPSVIQYLLQ

QPPVTETNLTKLVSNLEDELTVHITSNAIKRSGLYNIGKRATITSDANVENMNIKLGNKY

KHTIPVVMTLGMMACESVKQAFSEESKLPSTINIKSKLSTAIPMSEYTVDKAKFLEDRFT

NNKHIVIVYVGGESVTVSITFEKVKVTKEGVPPLYALIEGEQAILDIYNEQYQEKAVPKD

FVNKKILHADIGDGTTEYVYTVGLNPVPDNCTGERRGVGHATESAIALLKEDTNGRVLL

KRQQYMNILKDPSHRLFDEASRFLENGKYIQAMRILEDIQEKYTEKIAGDADIICVYGGG

SIEFESLLYDDLLEFCEEVNCKLLWIPEKYAVDMNMEGLDILNKKVFFKKG

Alp41 gi|169636508|ref|YP_001716049.1|pGS18_ORF52 [*Geobacillus
stearothermophilus*]
(SEQ ID NO: 134)
MKLVVANDIGNSETKMIVNDTLIKQPSVVKRLLSKPNVMETNVEKNIANLLDELIVHVT

SNAMKRSGLYFIGKRANMTADKVENMNIKLGNKSKHDIPVLMTLSMLAARSVQLAYQ

ENQELPSSISVDVSMTTAIPASEYSADQARYLEGRFTSNDHVVIVYVGETPVTVTLHFQT

VKVTQEGIPALYALLESENEILKNYNEHYKKQAVPKDFANKRILHVDIGDGTTEYIYTVG

MNPVTDVCSGEKRGVGHATEEATQLLKEEVGGFLNLNRQQFMDIFRDPSHNLHDLAVR

FMQEARYSQAQRILEDIQEKYSDIAGNVDVIAVYGGGSIQFKEELYEELLDFANTVHCEV

LWIPEKYAVDMNVNGLHVINEKILFKQHA

Alp41 gi|23100549|ref|NP_694016.1|OB3094 [*Oceanobacillus iheyensis*
HTE831]
(SEQ ID NO: 135)
MTKSRIAAVDVGNDALKGNYGKLENELYIPNVIAPDLEERPVIGIEELDDKEILENIHIRIH

SPALSENNLIYRVGSLATKTTNSQELDQGSSKSEEDQTLIMLLTSLALDAVSASDFEEKN

GVIDANYTLGTGLPLREVKEGKDVAYRSHLLSSVHQIEFLVTPKYQGKKVNIKFDEVKV

YPEGFAAYVNLIMDNDLKVINKDIIDKQILIQDIGGLSTDIAVIRNRNVDDDKAQGFNLG

VSESLEQIREEIRTKHGVELDSRRDVVDIITRKNDRNHIMVKGSRTNVHDITDHILLELAK

KEYRYLRNVWAKNSQSEICYFVGGGSAVLKDYIKALNNKLDGYNIEFFEDENESIWMM

ANAYYKLITDFVQKSSPQVVEKEKKTTKSK

Alp41 gi|168206979|ref|ZP_02632984.1|[*Clostridium perfringens* E str.
JGS1987]
(SEQ ID NO: 136)
MCIYFKVGNDNGNSEHDIIINDKLIAQPNVYSKVRKLPNLDEVNKEYVLEHIEDNLIVTC

EDPSGIYYIGNYALSSGQKIRNVEVGIDNNKLESEVIVINTLAQIAGQAVKEYYLKNKSFG

DIIKVKVDMATALPISSYSNKNAKLFSEKFTNKKHFITVHIGNEVARVEIEFEFVMVIPEG

VTSSFLFIQTDDALKKYNFKKEFFKNAKVLHVAIGEGTVEYPITKGIEFNPNFIKGSNNGV

GHAIDMALDEFKETKGLIKFSRQDYSEVLKNKKHKYNELAEDIIEQYIEEQAEEIFHNAT

KEIQKANNDIDVVCIYGGGSILMRSALEEKFKKFCDRADIKLLYFDKEDCVTLESLGLNV

LVNSKLFKTLKQNSTVKN

Alp41 gi|89096483|ref|ZP_01169375.1|B14911_12622 [*Bacillus* sp. NRRL B-
14911]
(SEQ ID NO: 137)
MVDLKNPRIAAVDVGNDSLKALFGKLDYELNIPNVIARDVADRPVIGIEELDSKEPLDGI

HVKVHSPALKDNNAIYRVGTLATKSDNASELDPGSSKSEEDQTLVMLFVSLALDAVREE

-continued

NAGLFPKNNNIIDTNYILGTGLPLREVKEGKDAGYRSKLLGSVHQVEFLVTPKYQGIKV

NLKFSDVKVYPEGFAAFINLVMDNDLNIINKELIDKRILIQDIGGLSTDIAVIKNRTVDDD

KAQGFNLGVSESLEMIREEIRSKHGVELDSRRDVVEIITKKNDRNHIMVKGSRTSVHDIT

DRILFDLAKKQYRLLRNVWQKNSQTEICYFVGGGSAVLKEYIKSLNNSLDGYNIDFFED

EKESIWMMANAYYKLVADHLKRTSKPDKQDEKKPVKA

Alp41 gi|138898362|ref|YP_001127547.1|GTNG_3469 [Geobacillus thermodenitrificans NG80-2]
(SEQ ID NO: 138)
MKLVVANDIGNSETKMIVNNTLIKQPSVVKRLLSKPNVMETNVEKNIANLLDELIVHVT

SNAIKRSGLYFIGKRANMTADKVENMNIKLGNKSKHDIPVLMTLSMLAARSVQLAYQE

NQELPPSISVDVSMTTAIPASEYSADQARYLEGRFTSNDHVVIVYVGETPVTVTLHFQTV

KVTQEGIPALYALLESENEILKNYNEHYKKQAVPKDFANKRILHVDIGDGTTEYIYTVG

MNPVTDVCSGEKRGVGHATEEATQLLKEEVGGFLNLNRQQFMDIFRDPSHNLHDLAVR

FMQEARYSQAQRILEDIQEKYSDIAGNVDVIAVYGGGSIQFKEELYEELLDFANTVHCEV

LWIPEKYAVDMNVNGLHVINEKILFKQHA

Alp41 gi|182624909|ref|ZP_02952688.1|[Clostridium perfringens D str. JGS1721]
(SEQ ID NO: 139)
MCIYFKVGNDNGNSEHDIIINDVLISQPNVYSKVRRLPNLDEVNKQYVIENIENNLIVTCE

DPSGIYYVGNYALSSGQKIRNVEVGIDNNKIESDVILINTLAQIAGQAVKEYYLKNKSFEE

IIKVKVDMATALPISSYSNKNAKLFSEKFTNKKHFITVHIGNEIARVEIEFEFVMVIPEGVT

SSFLFTQTDDILKKYNFKKEFFKDAKVLHVAIGEGTVEYPITKGIEFNPNFIKGSNNGVGH

AIDMALDEFKETKGLIKFSRQDYSEVLKNKKHKYNELAEDIIEQYIEEQAEEIFHNATKEI

QKANNDIDVVCVYGGGSILMRSALEEKFKKFCDRADIKLLYFDNEDCVTLESLGLNVLV

NSKLFKTLKQNSAV

Alp41 gi|75758838|ref|ZP_00738951.1|hypothetical protein RBTH_04478 [Bacillus thuringiensis serovar israelensis ATCC 35646]
(SEQ ID NO: 140)
MASLKGKTLHIDIEGDIGNDSFKGYINGEYIKMKNVYQSVYSMPNVTETNIQKNVVNLV

DNMFVNIASKSIRRSGMYFIGNRAMLTGKNPKNMNIKVGQKYNDDLPLINMLGLIANKS

VQLEWERTEQLPQSINVTVDLISAIPASQWTPVNAKHLEQRFTSNHVVVVYVGEEQVT

VSLTFNSANITQEGVPPLFAILEGEEEMFTDFTKLYAKKLEIKKIDGAFFKNKKILHSDIGD

GTTEYIYTVGVNPVIDACSGERRGVGHATEEAVKLLNQERGTNIKRQQFSQILQDIDHKY

HEEATTHFNITKVEQAELILEDTDEKYVNNTASEAEVLCVYGGGSITFKDELYNQLLEYC

ERVGMYLLWIPEKYAVDMNAKGMQIIKKILSRKKVK

Alp41 gi|167939412|ref|ZP_02526487.1|hypothetical protein BcerAH1_24731 [Bacillus cereus AH1134]
(SEQ ID NO: 141)
MAEKNLVSEVKEVESVVEKKVVAEADLGNSNLKIFINDKYLSVPNVFQRVHGGVDSYE

TDEQKNVINLLDDLHVHVTSEAIERNGSFFVGKRAMRNSEKMKSMNIKVANKHEEDLP

VINTLSVIAANVIQSVYEEAKSVPDLLKVELDLMTAIPASQHNPKTAEILSERFSSNTHVV

IVYVGKKAVTVQIECSRVRVTKEALAALYAITEGPDEMFEEFQELYAEQLNNEKITGKFF

KDKKILHGDIGEGTSEYIFTDGLSPVLDSCSGARRGIGHAIEEACNLLNKDRKTNFKRQQ

FTEIMLDKNDKYNEDATEFIYETRYEQAELIKEDLEQKFINDTGGRAEILAVYGGGSIAL

KNELFNKLKKFCETTGMMLLYVPEKYAIELNPKGMNVLRKIID

-continued

Alp41 gi|168205266|ref|ZP_02631271.1|conserved hypothetical protein
[*Clostridium perfringens* E str. JGS1987]
(SEQ ID NO: 142)
MTVKEEKIMKMSNDNGNGDSKIIVNGALTIQPNIIHKKGFETPETGGWNISKIKNLKNNL

IIGVFEKPEINFFDEEDTEEEVESIYFIGSYALQSGLKTVGLNIDVDEDKMKNPITVISTLGY

AAAQAVKERVLDLEKSLGRPFAIEDIDSIGDLDLKVDLTTSLPARIYSLDKADTLASKFK

NKEFKLKIYVPNNKFVNVKIKFNNVGVVSEGVTTVYYLANIKNNIFDEFNKNNDDVKID

NEFFRNPNNTILHVAIGAGTTEYPRTNGYDWDDVYKTGSKNGTGHAIKDALKVLDKID

GTQNIRNPKAIERILKNKGKEKDGTKNLFYNEIKKSLTMPLMTQVDEIMDHIIEELNRGP

QISLVVIYGGGSILMKPILKKRIMELQETRRLKFLYIPEEYAVNLEAYGLYTLVSSPDFAG

NSSLRSK

Alp41 gi|167939846|ref|ZP_02526921.1|hypothetical protein BcerAH1_27045
[*Bacillus cereus* AH1134]
(SEQ ID NO: 143)
MSILLKAGADAGNNGLKLMVKGQDPIFIPSIYSLYIGEPTGLLDEVDVSLSELENHIDVTI

SSPSLMLNNVRYIVGEKVIQDQLKGTEVEKKSNKSTDELMVITILSGLAVSAMRQSPTSS

HINIRYDLSVALPMQLITQEIAAENAKRYMGNHKVIFHYPNGRDVTINVSIEYCKCLPEG

ASGTWGIVYDEEGNVVKHKIECEQNQVSEIDFVDKTLLSFDIGAGTTEEVVSLGVNFRPQ

LSKGLSYGVKETLLQIITRWNRKYPTKTIDSITEFNQIYLNDKHPRNTLLVEESQPALLGL

AARVATDIINKIDDMKDDPYVFIYGGGAVIIKNSLKMILKQKGRLKNVIFVDNPLFTNAR

GLLVYTCSPKYREHKQKELGFTNLTIS

Alp41 gi|30020866|ref|NP_832497.1|hypothetical protein BC2745 [*Bacillus
cereus* ATCC 14579]
(SEQ ID NO: 144)
MSILLKAGADAGNNGLKLMVKGQDPIFIPSIYSLYIGEPTGLLDEVDVSLSELENHIDVTI

SSPSLMLNNVRYIVGEKVIQDQLKGTEVEKKSNKSTDELMVITILSGLAVSAMRQSPTSS

HINIRYDLSVALPMQLITQEIAAGNAKRYMGNHKVIFHYPNGRDVTINVSIEYCKCLPEG

ASGTWGIVYDEEGNVVKHKIECEQNQVSEIDFVDKTLLSFDIGAGTTEEVVSLGVNFRPQ

LSKGLSYGVKETLLQIITRWNRKYPTKTIDSITEFNQIYLNDKHPRNTLLVEESQPALLGL

AARVATDIINKIDDMKDDPYVFIYGGGAVIIKNSLKMILKQKGRLKNVIFVDNPLFTNAR

GLLVYTCSPKYREHKQKELGFTNLTIS

Alp41 gi|168157476|ref|ZP_02592709.1|hypothetical protein BcerN_24266
[*Bacillus cereus* NVH0597-99]
(SEQ ID NO: 145)
MSILLKAGADAGNNGLKLMVKGQDPIFIPSIYALYIGEPTGLLDEEDVSLSELENHIDVTI

SSPSLMLNNVRYIVGEKVIQDQLKGTEVEKKSNKSTDELMVITILSGLAVSAMRQSPTSS

HISIRYDLSVALPMQLITQEIAAENAKRYMGNHKVVFHYPNGRDVTINISIEYCKCLPEG

ASGTWGIVYDEEGNVVKHKIECEQNKVSEIDFVDKTLLSFDIGAGTTEEVVSLGVNFRPQ

LSKGLSYGVKETLLQIITRWNRKYPTKTIDSITEFNQIYLNDKHPRNALLVEESQPALLGL

AARVATDIINKIDDMKDDPYVFIYGGGAVIIKNSLKMILKQKGRLTNVIFVDNPLFTNAR

GLLVYTCSPKYREHKQKELGFTNLTIS

Alp42 gi|19552885|ref|NP_600887.1|hypothetical protein NCg11611
[*Corynebacterium glutamicum* ATCC 13032]
(SEQ ID NO: 146)
MTSAVNVQKKTTQKVLKPINTKNYSATDAVQTGQHGSALGSNIGVYTYTAGLDIGNGY

VKGIIEATGDTTGTSVDVIDMPSAATRMSRPTEVPEPDDTAVAVTGADFFNHIDTNFNSP

MVKGNYRYLCGTRSLSARGSLEEFDLVGNRSKAEQELSKVLVMAVLAAKAVKDFVAA

HGRIPQVAVEGDPGVLRVHTYLALALPINEYVGHRHGYKAQFMGDGAANPAVHVVTV

-continued

NNFETPATVQLIFERVEVIAEGASAQYAITAGGEVLMNGMLADVRSKGLALEGVTAGD

VLQARHTIGVDVGEGTVNFPVFTDGRFNHDASRAYDKGYGTVLESAIQAMDDAGLAH

NFNSRKQLADYLQRPPSALKRNFYTRVEQHVDQEAVFFVQDVAAEFARVLSDVGALTE

VAFVYGGGSGPLRDRLHEALLIKAAEMGSEDTFPVLYLDSAYSRKLNREGLMIAARSIA

AKARK

Alp42 gi|90962843|ref|YP_536758.1|pMP118 LSL_1868 [*Lactobacillus salivarius* UCC118]
(SEQ ID NO: 147)

MSKNNILKLNVANDLGYGSVKAKVEDTNIHFPSVIAIQREQDLNKPVEFNSNQEKLTYL

EGMINHMDVTISSSAVKTQGRFLVGNAAIKSSLPLKAFDVNDFTGKSDNDLAIILTLSMI

AAQRISLAVKNGEDLSDQLSTEINMTTALPVSEGKKNGIINNYVNKYISSKHTVVFHNFK

DPITVSLNFKNVYVALEGEVAQLYLKNSDIKLQGLIKQDFSKNYPELANDIKVSDLVKID

NLLGIDIGEGTTDLVVIKEGHANAVASTSLPTGYGNALQDAIDVLQTENMNFEARSQLQ

DYLAQEVSPLAKRMQTKVRQIVFEQLEPFADKIVTAASKTMRKAGANVEILYVYGGGSI

PMLEQTALRQKLSQKMKDFSGGIDVPVIWINKSYAQNLNEKGLELILKAMNK gi|254850896|ref|ZP_05240246.1|conserved hypothetical protein [*Vibrio cholerae* MO10]
(SEQ ID NO: 148)

MFVLGVDIGYSNLKLAIGQSGSEPKTIILPAGAGPADRMPERIGGGDDETCLYVSVDNER

WAAGVPAGRLQGWERELHPEYPTTKTYKALFHAALLMAETESIDLVVTGLPVSQFHEP

QRKSDLVKRLKGVHQVTPKRSITVHDVKVLPQPAGAYMDLVQTGGDLGLIEEGRVVVI

DPGFFSVDWVALEAGEIRYSSSGTSLQAMSVLLETIDKLISEDHGAKVGMDRLEKAMRT

GDLQVLLFGEKVDISPYLNAAMKKVAPVALTAMRQSMRDESINADLVLIAGGGAMAY

KEAAKEIFSRSKIIVPEQSVLANVRGFWFYGA gi|65320431|ref|ZP_00393390.1|hypothetical protein Bant_01003833 [*Bacillus anthracis* str. A2012]
(SEQ ID NO: 149)

MKSLYAIDVGIGFTKRVYRQDEDSEVTVKSEASTLAPVPNHDESEDLTKVSFIDLDFAYY

MGNEAHQSDASFLPPFEEEIENYYESEQFKQQIFGCIAKDYKENVVLPLVVTGLPVTYFG

SQHEQLQRALKKETSVQIDGKFIHITVENALILQQPVALHAYFLKEGIIQERDRILIIDGGF

RTLEMTDMKQNVILNHYETELGCSKPLKNIKNIVQNHAGESDHLHINDMPNILEKGYGG

REEDPQTNQVHILIQKERMHTSKTLCVYYKNNLS gi|113477981|ref|YP_724042.1|hypothetical protein Tery_4593 [*Trichodesmium erythraeum* IMS101]
(SEQ ID NO: 150)

MVIKQPAAAAMLTQKPSNINKKAILSADLGRTATKACVSRTQNGVVFIPSNVKQLSVDQ

VRAGNFESKPTDPLLDMWLEYQGYGYAVGQLAADFGANLFGDERSFAKSKIEDALVK

VLACAGYFQLKGEFSVVIGLPFYNQEQFEKEKAQIISQLESPHQMFYRGGEEVEIRINKV

WVMPEGYGSLLWTEANHGKEFQPQLPKLSLAIVDIGHQTTDFLMVDRFRFARAASKSE

PFAMSQFYEDVASKIEGADSQSLYLLEAVHKPEGQRSYRPKGATKPINLDGIIPELRKVF

AAKLCDRLIKWIPERVSDVILTGGGADFFREDLEKLLQEAGLKSHLAQPPREANALGQYI

YGEAQLAISK gi|186686689|ref|YP_001869883.1|hypothetical protein Npun_CF030 [*Nostoc punctiforme* PCC 73102]
(SEQ ID NO: 151)

MINIYCADIGNYSSITALKGEKPRVMRSVFQDVTYTSARDLDTDNSPSIKLDDKVLVLGD

RATKQKNSQTAAERGKDLPEFFKPFTLAGLRQDFDGVVRFLVPEHSQWHEDTIRRTLVA

EHQINVNGTNYRHRIKNVEFFLETDVAVINAYRNGKLDMDGDTLAIDIGGGTTNYVVIT

PSSEVLTRRSIPKVGGVSLANDIINSDLMQSYAKRDNVAFKVAKMMDAIADGSFTYGRK

YDFSSVFPGLLENWFNNLMDSISTAANDYLADVTNVMLIGGCANLVRQKLSAKQGFYIP

ANPQLSNIQALLAM gi|186684586|ref|YP_001867782.1|hypothetical protein Npun_R4472
[*Nostoc punctiforme* PCC 73102]
(SEQ ID NO: 152)
MTDQPSAANPMNSAAIPMNRQPLASTTPINAVNNNPPTTTKSGGGSGKTILSVDLGRTST

KTCVSREPGSVVFVPANVKQMSIEQVRGGVFEARATDPLMDLWLEYQGNGYAVGQLA

ADFGANLGVGQSKVEAALVKVLASAGYFKLRDDISVVLGLPFLSLEQFEKEKAQLISQV

GGPHVLNFRGESISLNVSKVWVMPEGYGSLLWSEAQPKKSPSSPDFTKISVAIVDIGHQT

VDLLMVDNFRFARGASKSEDFGMNKFYELVSAEIEGADSQSLALISAVNKPRGERYYRP

KGASKPTNLDDFLPNLTEMFSREICSRVLAWLPERVTDVILTGGGEFFWDDVQRLLKE

AKINAHLAAPSRQANALGQYIYGEAQLSSNRAARA gi|30262713|ref|NP_845090.1|hypothetical protein BA_2740 [*Bacillus anthracis* str. Ames]
(SEQ ID NO: 153)
MSILLKAGADAGNNGLKLMVKGQDPIFIPSIYALYIGEPTGLLDEGDVSLSELENHIDVTI

SSPSLMLNNVRYIVGEKVIQDQLKGTEVEKKSNKSTDELMVITILSGLAVSAMRQSPTSS

HINIRYDLSVALPMQLITQEIAAENAKRYMGNHKVVFHYPNGRDVTINISIEYCKCLPEG

ASGTWGIVYDEEGNVVKHKIECEQNKVSEIDFVDKTLLSFDIGAGTTEEVVSLGVNFRPQ

LSKGLSYGVKETLLQIITRWNRKYPTKTIDSITEFNQIYLNDKHPRNALLVEESQPALLGL

AARVATDIINKIDDMKDDPYVFIYGGGAVIIKNSLKMILKQKGRLTNVIFVDNPLFTNAR

GLLVYTCSPKYREHKQKELGFTNLTIS gi|117676207|ref|YP_863783.1|hypothetical protein Shewana3_4268
[*Shewanella* sp. ANA-3]
(SEQ ID NO: 154)
MNNPVIITVDVGYGTTTCVHKESLGNYSVKTFPSLPIPIKSDINLGLAGEERDVTNVEVD

GITYEVGSDVGTSVGSRNVRVLNTESFITSDRYKALLFGALSFLGKSNHIDIDVLVLGLPV

SVMFRKDELAKIYTGTHQITPSRKVTIRQVLVFEQPLGALMSFLRQGGNERFAQCKDKT

MLSIDPGYMTTDFITSKGLKVSPNRSGDSETGMSKVIGAVEVALRSQLEGFNIKQINPELI

DQAFISGELKLYGKAMKFPKCDLFDVTSAIRSVTDEALTSVVNKVGDGQDIDLIIVSGGA

AAVYLPSIQRAFPFHKIEVVDDSLTAVARGLQTAGEQFIRGAIARGDYQKLKAV gi|134287988|ref|YP_001110152.1|StbA family protein [*Burkholderia vietnamiensis* G4]
(SEQ ID NO: 155)
MTKNAAVSEEVGNVVHLQPEGEVRFAGTDDGHDGIKIVTDDWRQIHVPSRITRGADLIS

LNDADDNVYEGPDGTLYAVSPTLPYFDTTFSDYALSDINLVLVHHALAKAGLGGQRVN

LVTGLPVGDYYVANRPNVDFISRKVAHLRENTVRNKNESVALATIVKHNVVSEAIAAFF

DLLLDREGNQRDDVAEMVATGGIAIVDIGGKTTDTAVVMNGGRDVDGKRSGTDPIGGL

SLNKAVENELKAEFSVTALNPAQVDRAVREGVLRLYGKDHDCRAIIDKQKSELAKQIIA

ATHRKMRDASDLERVFFVGGGALLLCDQLEELYQHAEFVEDPQFANARGMLKAAMFL

QPR gi|134288378|ref|YP_001110541.1|hypothetical protein Bcep1808_6851
[*Burkholderia vietnamiensis* G4]
(SEQ ID NO: 156)
MQNQTIIGLDVGRSAVKATAFASGMFYPLTFPSIVSPAIDLTDESTARKAEAETIVVAGR

RYFTGDTARLQGSAGTTVGLSHNWTSTPEYLALVGSTMKRFAAKGVPGLTDPLLVIGTP

ASLYGSQQEQLKAETLKIVQAEIRVLPQPMGAYCDFYLDKSGVPVKTHMQDDAGRKKS

WAVIEVGHFTTDFLLMLEGQYIERGASSCEGLNFAAEHLLRILNAKDIHSNLIECELAIRT

KTILQYGRDVDIAEEVAEAVSHVAQKIISKADSLLSTDVRKLHGVLLAGGGAPLLYDELS

KKWPHCMLLDNPRMAVANGFCRYGMGIALRRAMRSQQESVNV gi|47564291|ref|ZP_00235336.1|conserved hypothetical protein protein [*Bacillus cereus* G9241]
(SEQ ID NO: 157)
MKSLYAIDVGIGFTKRAYRQDVDSEVTIKSEASTLAPIPNHAESEDLTKVSFIDLDFAYY

MGNEAHQSDASFLPPFDEEIENYYESEQFKQQIFGCIAKDYKENVVLPLVVTGLPVTDFG

SQHEQLQRALKKETSVQIDGKFITITVENVLILQQPVALHAYFLKEGIIQEQDRILIIDGGF

RTLEMTDMKQNVILNHYETELGCSKPLKNIKNILQNHAGESNQLHINDMPNILEKGYGG

REENPQTSQVHTLIQKELDAHFQDVMRVLQEQFKLEQYDTIIWTGGIVDLHKKRIEKIQG

EISSFRMVDASKEAALHGYYMIGSQVFDDITNQSVYESKL gi|124262661|ref|YP_001023131.1|hypothetical protein Mpe_B0117 [*Methylibium petroleiphilum* PM1]
(SEQ ID NO: 158)
MLTKTIIGLDVGRSAVKVVAFANGLYYRLTFPSLVSPAFPINDEGTAARAELETVEVLGK

RYFTGDTARLQGGVNMSVGLSHDWTNGPEYLALVASTMKRLAALGVPGLDSPYIVLGT

PASLFGRQKEALAQRTQAVVAAEMKVLPQPMGAYCNFFMDARGVPIKDRQKRPDGKN

RSWAVVEVGHYTTDFLLMREGNYIERAAVSCEGVHFAAENLVRILAAKDIQATPLTAEE

ALRTGVIVDFGERRIEAQVAEAVDHVVQKIMTMADSVLSNDVRSLDGVLLAGGGAPIL

AAGLQKKWPHTVLLENPRMAVADGFCRYGVGQMLRRAMAAEKATA gi|57505927|ref|ZP_00371851.1|hypothetical protein CUPA0063 [*Campylobacter upsaliensis* RM3195]
(SEQ ID NO: 159)
MANEIQKIAIDIGYGDTKVAVGKEVFKFASAISKQKEAQSEYFEGKNEGVYDFLGKKYF

VGDNALFEAVSTRGFDFLVKYSPLLVYHAIKKANFDLSKDIHIFTGLSIVNWGEKERFLE

SLKSIKVDNDILSPKITLMAQGQGVFCDYEKEKEGLVCVVDIGYNTFDFLVFDNGNPRQ

DLSFATKKGANVIITELQNIIKKRYSLDISEQSSKDIFQNGFIEIYGEKIDLSDSIDDLKEEYS

EFIINELRNQREDIVKTAKRVIFSGGGAYFLDNVKSLKNVKNVDFSDKPYEYANVKGYL

KWKK gi|134287584|ref|YP_001109750.1|hypothetical protein Bcep1808_7086 [*Burkholderia vietnamiensis* G4]
(SEQ ID NO: 160)
MFPSLAPLAASRSIAGYGESVLTARKVATIVIDQVEYEVGPDVSLTAAYGNTGRALADD

YVLSANYAALLFGAIHFAGVDHIERLVLGLPVHNMKKYAAELKERFTGELDFGAGRVKI

DKVMVIPQPLGSLVLASSNRPGGFGRDVEHLVVDVGYFTTDWVYANGFTMDDKRSGG

MPGGASQIYQRIAALIARDQGDEVEDIERIDKALREKTPFFFYGTNVDLAPYLEMAQPLI

SGVVKEMQNNVGRLANVRSIILSGGGAALYAAVIRRAFPRVVIEVIDAPCLANVRGFLL

VGESSLARERR gi|75764516|ref|ZP_00743991.1|hypothetical protein RBTH_08102 [*Bacillus thuringiensis* serovar *israelensis* ATCC 35646]
(SEQ ID NO: 161)
MKSLYAIDVGIGFTKRAYRQDVDSEMTIKSEASTLAPVPNHTDSEDLTKVSFIDLDFAYY

MGNEAHQSDASLLPPFNEEIENYYESERFKQQIFGCIAKDYKENVVLPLVVTGLPVTCFG

SQHEQLQHALKKETSVQIDGKFINITVENALILQQPVALHAYFLKEGIIQEQDRILIIDGGF

-continued

RTLEMADMKQNLILNHYETELGCSKPLKNIKNILQNHAGESNQLHINDMPKILEKGYGD

RDENYETSQVDILIQKELDAHFQDVMRVLQEQFKLDQYDTIIWTGGIVDIHKKRIEKMQ

GEIASFRMVDASKEAALHGYYIIGSQVFEDITNQSAQKSQL gi|75758323|ref|ZP_00738447.1|Hypothetical membrane spanning protein [*Bacillus thuringiensis* serovar *israelensis* ATCC 35646]

(SEQ ID NO: 162)

MKITMMNKDSGNSLDMNLIDGFYIETPTNVVEISKDEADSHFVATITNPKELLSRLLISTT

IPGEDTERFFLVGDEAGKHALANNHVNKLHDKITSPIPYVMFLSAVSFYHAINETRESDD

NTVEIEYFQTMLPIWLLKRTAKFSEAQNAMAERFAGEHEVTIHTPGMEKTLKITVEKAT

CRIEGEIARLAIKKNFELEDREEARQFDNNDTVLVDIGGGTIDLVLSPAGLKSPKNRDSM

QPIDKLSYLSHIEKLRKEKFLEKFSDLRSFETFIVNNFQKPKMELVDGNTGQRVDLTDKIR

SSLKEFAKFLILKIQDVMPAPADKVYKYVYFGGVAPILETSIHEVIEEMYGAEIAQANHIF

LPDSRKLNLYGLEVKSRGEMLQKTEK gi|75759083|ref|ZP_00739189.1|Hypothetical protein RBTH_07086 [*Bacillus thuringiensis* serovar *israelensis* ATCC 35646]

(SEQ ID NO: 163)

MAYTGVLLSKTRRQPRPNKIFMQKAKVMVLDIGAGTTDLIVIDQGKAIERSKYTIDLGG

NNITQTLRTTVQTNLEIRLSAQVFEQGVITGKVKQGLKEHDVTDELIGAKRSVAAKISKE

VKDYLESSGIEANSIEYILVVGGGSIPSENDKVKPISDYLLDSIKRFAPQVGLVDISDIITKP

NSVAFENVADADFVSSRELNISGAGTVTDLLEIKQYLAQQEQAKQVQA gi|167036509|ref|YP_001664087.1|hypothetical protein Teth39_0078 [*Thermoanaerobacter pseudethanolicus* ATCC 33223]

(SEQ ID NO: 164)

MFKVGLDLGYGYVKGINEKGKEVLFPSLVGNAYERVLSGLFGTDNNKADNMHVVIVN

ENKEEYFVGELARREGKNVSYAFDEDKIYHPNTRALLTASCLLLLPEEEVPVHIVTGLPL

EQYIHKKEEFKNMLKNFKVMAYFKGDEKVKTIKFEKVTIFPQAAGAVYHAVMADIQKY

LVKGSYIGLIDIGFKTTDYIVFMVEDKLILREDMSGTVEVGMSALNNTVDKIFTQRTGSKI

DVSELIRLISDGKIFYKGRELDFTKEIDAVRSEIARVMKDKIKLIWGSKLDFFNTVFLAGG

GAKELVEYMKDFYEKIVLVKNAQFANARGFLKVAELEEKKAVNVR gi|167036475|ref|YP_001664053.1|StbA family protein [*Thermoanaerobacter pseudethanolicus* ATCC 33223]

(SEQ ID NO: 165)

MFKIGLDLGYGYTKGINETGRMVLFPSLVGNAYQRNLIGLFGQNLNNLIENMHVVLRN

GKEEQEEYFIGDLARREGRNVSYAFDENKINHPNTKAVLASASALLFPSNDEPVHIVSGL

PLEQYIHQKDELRDMLKNFKAIVEFKGYNILKIVKFDRVTVFPQAAGAVYYAIMDDLQK

YLIKGSYIGLIDIGYRTTDYIVFVVDGKLSLREDLSGTLDIGMSQLNNAADKLFTQKTGS

KLDIPELIQLVNEGSIFYRGKVLNFEKELNEVKLEISRVIQDRIKAVWGSKLDFFNTIFLAG

GGAVSLFDSLKNLYENTVLVKNSQFANAKGFLKVAELEEKKERDRE gi|120536986|ref|YP_957044.1|StbA family protein [*Marinobacter aquaeolei* VT8]

(SEQ ID NO: 166)

MKTKRRAIDNGYNHHKVAWVEDGKIKTIKYPAILGSSTEAMTELGGGYANMYESTSGE

RFVVDEHVSNRISLRTGDYGLTEGNRVLVNHGLRETGIKPDDEVMLVTSLPVRDFFSSD

GSRNEDLIAGQKESMMKPVKVVLNNTDDPVRVANIVRSDVVSEAVAAAFDFLVDNVG

ESAKPLHAPLAVLDFGGSTFDVVTLTKDLRIRHASSGTLKRGTMDIIEPLKRLLLKHAQE

-continued

MKIKVSEIPDWMINQVMATGKMPYFSYEDGKPKNTEMPVNDVIEAAAAETVSEIKAFV

KQKIANFSEYQAVLLVGGGSLLCRKLFRDWEELPQFIVMDEFANARGMLKLVSI gi|146296416|ref|YP_001180187.1|hypothetical protein Csac_1394
[*Caldicellulosiruptor saccharolyticus* DSM 8903]
(SEQ ID NO: 167)
MKCGIDVGFGFTKAASEKGKKVVFPSAVAKTFMTDVGLKPTSDYFVTYMNQTYAVGR

AATQCLITETSFSEERFSTDFSKLLVLTALMALECDREVELGLGLPLMLYPKLKEKVKDY

FEFSEEIIINSNGIAHSYHITRCEVFPQGVGALFSISSPVEDGIYCILDVGFRTTDVIVVEIRN

RNINPLLDMCFTVDKGMSLAIERLGLMIERKYGVSYDTSLLFDIHERSHISVRGRKIDIEA

HKKEVFTAIADDIVQSISRRLQRGFDTFDAVLVAGGGAFNVASVLQKEFENVYVLDDSQ

FANAKGYLTLLNLGV gi|146297649|ref|YP_001181420.1|hypothetical protein Csac_2658
[*Caldicellulosiruptor saccharolyticus* DSM 8903]
(SEQ ID NO: 168)
MLVLTALMALESDREVELGLGLPLMLYPKLKEKVKDYFEFLEEIIIDKNGVAHSYHIARC

EVFPQGVGALFSITSPVEDGIYCILDVGFRTTDVIVVEIKSKNINPLLDMCFTVDKGMSLA

VERLGLMIERKYGVSYDTSLLFDIHERTYISVRGRKIDIEPHKKEVFRAIADDIVQSISRRL

QRGFDTFDAVLASGGGAFTVASVLQKEFSNVQIVENSQFANAKGYLALLSLGL gi|120597909|ref|YP_962483.1|hypothetical protein Sputw3181_1079
[*Shewanella* sp. W3-18-1]
(SEQ ID NO: 169)
MFVLGVDIGYSNLKLAIGQSGSEPKTIILPAGAGPADRMPERIGGGDDETCLYVSVDNER

WAAGVPAGRLQGWERELHPEYPTTKTYKALFHAALLMAETESIDLVVTGLPVSQFHEP

QRKSDLVQRLKGVHQVTPKRSITVHDVKVLPQPAGAYMDLVQTGGDLGLIEEGRVVVI

DPGFFSVDWVALEAGEIRYSSSGTSLQAMSVLLETIDKLISEDHGAKVGMDRLEKAMRT

GDLQVLLFGEKVDISPYLNAATKKVAPIALTAMRQSMRDESINADLVLIAGGGALAYKE

AAKEIFSRSKIIVPEQSVLANVRGFWFYGA gi|150019823|ref|YP_001312077.1|StbA family protein [*Clostridium
beijerinckii* NCIMB 8052]
(SEQ ID NO: 170)
MRISADIGYNTTNFIGHNIEGSFSSTVKEKMHELETAKYTVEYNNKTYLIGNDDGFTSIEH

SRDKDIIFHICLYTAIAATMSSTIDNNVRVITGLPAQFFAEQKNSLIKALENRRVFMKLNG

ENRSFTITKVIVFPQSAGLFLYDKSLVEKDTLVVDIGGGTLDIAYMSNGQFKEGRTYPLG

VNPTYDVLLQELTKYGVNYSNRMKAEQIIADKAIFVEGKEIDVSKDIDNVLSLRAGEIIN

AIKQAFPEQSKYSRFVFIGGGALLLKNYLKDYRVLDDAQMINVKTYDIIGKSKNV gi|121582927|ref|YP_973369.1|hypothetical protein Pnap_4345
[*Polaromonas naphthalenivorans* CJ2]
(SEQ ID NO: 171)
MKPSILAIDIGFGNTKATWSHRTLAGKAEAWSEIIFKSVCPLALDDDIAPGQATSNLDRV

AVSVAGQAYYVGPKADREGGLRALHPDYINTPTHEALLLGAWHYMFKETGIVSPSVDM

LVLGLPVSGFSANKKVLKEIGSRVRRVPVPMPMRSRLGKAYVDVSAKQVVVLPQPLGG

LRLAAQSALELADDGVISMVIDPGYLTFDWLLSDGMAPHYELCGSFQGGVSQLINAVA

KRLSQDHGIESADFAMIESALAKGELLLDLKRIDMTPYRKLAGQQAQDMVAQWLMRF

NPYKAGVSRIFVCGGGAGFYIDALKARLPHIRMDVMPEGVMSNCRGYFLTGQDMFAD gi|88706892|ref|ZP_01104591.1|bacterial StbA plasmid stability protein
[*Congregibacter litoralis* KT71]
(SEQ ID NO: 172)
MTERIDKKPTQADKTSQLTSDPMSVVQVGLDDGYAYTKVALADGRLFSAPSRARIGSA

GVTWIREQEQRIFEYETGGTVYSVGAVDGEATQFDEYPSSALNRVIVQHAFQQAGLSGR

SIHLVTGLPVSAYYRHDGQLRQQEIDRKCESLKLSVEPKPNSAKPGKSILSASVAFHEVIP

EALAAWYDHVIVTQADGVTLDGDRLSAPIAIVDIGGRTTDFVVVQDQGIVHGSSGSLNR

GMLNVKSRVADLIQQTFDMSELGEQSIARAVDSSRLRLHGKDHDISAMVAAAKRELVE

LLYAETRRKLGLGVELDQVLFVGGGSAALATDIANWFPNQTIPDHAAFANARGMLKYL

QYVCDDTAGGF gi|88707200|ref|ZP_01104890.1|bacterial StbA plasmid stability protein [*Congregibacter litoralis* KT71]
(SEQ ID NO: 173)
MDALAVGLDDGYAVTKVALATGQLFAVPSRGRIGSAKITAVNQNDTGIAEYMSGDEHI

AVGVDDFDATGFDDYPLSAVNRAIVQHALLAAGLSGRSIHAVSGLPVARFYHSDGQRR

DALIASKTKSLLAPVQPLDGRPPVSIACHDVIPEALAAWYDHVIIEDGTEWVRLDESAVE

APLAIVDIGGRTTDFVVVADEKLWHQSSGSITCGLLDLRGSVAEAICAVHDLDSLSDAG

VDQALTENTIRLFGKDHDVTAIVSKARQQIVLRIEQETRRRLGRGAELERVLFVGGGSVV

LADAIRHWFPNQAIAPHPAFANARGMLKYLRYVGLPSE gi|134298835|ref|YP_001112331.1|hypothetical protein Dred_0971 [*Desulfotomaculum reducens* MI-1]
(SEQ ID NO: 174)
MSKVVAIDFGYREIKGVNSEGLEIKFPTAMAPYVKHPTAEGLEEVVTVTKPGYEPEMYF

YGQKALDETGVGFTNDRDKHLHSGHDILMLAAARKLGYENGDTLVVGVPISYADQRE

ALKTQLERLHGDVSVDGGKPKRISFNDVLVLRQGIVVFGLIPDLPNGTLISFDIGEHTTDV

STVKFKNGVIEPNPSKCFSLEYGYSKVVEAIQKEFQSKAGSPVSGEQARAIAEEGYVIYK

LKKLDMTLEVLRAKEEIAKNIVKDAKKRLGEIADFAAGFYLCGGGADVLPLKELLPGAV

IVDNPQTANARAYLQLAMSE gi|121998776|ref|YP_001003563.1|hypothetical protein Hhal_1997 [*Halorhodospira halophila* SL1]
(SEQ ID NO: 175)
MERCIGLDMGYGFIKIDDGREGHVFPSVVGEGESGMPMSLGVAQRSGSSELRITYGGKS

YLLGDYAIRHSRLAHRGLSPTRAEGDDLKILFLGALSLYARETVNNFHVVTGLPPGRMH

MADDLVRQLRGDHEVIRHVGASRFGVSIRLEQIEVVPQPVGSFWAEVLDDRGQIRGDHP

LLNGRVGIMDIGFRTSDFATVIDGEYSPGFCKTVPLGISFGYEEIAQELSTQYGLEREQYT

LDEAIIQGQVNVNGRPVDIVELRDRIFGDIATKLLVEARSMWQIQEYDHIIITGGGGRVLE

RYLRPELSQAQLAQDSVTANARGYFNWAYFNAQQRAAEMGHATEQSSAEDYSSGSYG

TGSTTYSRGGDDGRDSAAVPQSRSGSEG gi|89096483|ref|ZP_01169375.1|hypothetical protein B14911_12622 [*Bacillus* sp. NRRL B-14911]
(SEQ ID NO: 176)
MVDLKNPRIAAVDVGNDSLKALFGKLDYELNIPNVIARDVADRPVIGIEELDSKEPLDGI

HVKVHSPALKDNNAIYRVGTLATKSDNASELDPGSSKSEEDQTLVMLFVSLALDAVREE

NAGLFPKNNNIIDTNYILGTGLPLREVKEGKDAGYRSKLLGSVHQVEFLVTPKYQGIKV

NLKFSDVKVYPEGFAAFINLVMDNDLNIINKELIDKRILIQDIGGLSTDIAVIKNRTVDDD

KAQGFNLGVSESLEMIREEIRSKHGVELDSRRDVVEIITKKNDRNHIMVKGSRTSVHDIT

DRILFDLAKKQYRLLRNVWQKNSQTEICYFVGGGSAVLKEYIKSLNNSLDGYNIDFFED

EKESIWMMANAYYKLVADHLKRTSKPDKQDEKKPVKA gi|118602027|ref|YP_908727.1|hypothetical protein P912780RF_129 [*Photobacterium damselae* subsp. *piscicida*]
(SEQ ID NO: 177)
MSQFVLGLDIGYSNLKMAMGYKGEEARTVVMPVGAGPLELMPQQLTGGAGTCIQVVI

DGEKWVAGVEPDRLQGWERELHGDYPSTNPYKALFYAALLMSEQKEIDVLVTGLPVSQ

YMDVERREALKSRLEGEHQITPKRSVAVKSVVVVPQPAGAYMDVVSSTKDEDLLEIIQG

```
GKTVVIDPGFFSVDWVALEEGEVRYHSSGTSLKAMSVLLQETDRLIQEDHGGAPGIEKIE

KAIRAGKAEIFLYGEKVSIKDYFKKASTKVAQNALIPMRKSMREDGMDADVVLLAGGG

AEAYQDAAKELFPKSRIVLPNESVASNARGFWFCG
``` gi|163937904|ref|YP_001642790.1|hypothetical protein BcerKBAB4_5321
[*Bacillus weihenstephanensis* KBAB4]
(SEQ ID NO: 178)
```
MTVDYIGVESANSFVKVASANEELCYLNTLRRVESFEDTTGLTVYTYEGIRYVIGEAQGI

SSSARNDDRYSSAGYRTETILAISQLVKDGSEIVVGTGLPSEDYKNGDNHEKVKRNLVG

EHTVQIDGKTKTFSILRVYTPMQPIGSVVNRIYDYNLKVRKDMESERTARKLVIDIGFGT

TDVCEAEGLRIVRYDGVQVGMLEANRIIKDELSKRGARGIVSLLHMDTLLRNAKREYV

KDEFTDKEILSKVIIEIGGKEYEIKDLMEQALEYTARIVMQRVDNLGYVLKDYDVVLFTG

GSLLALHKYIKPYLTGVNTKAEQGAQTANVKGYTKYAMIQDAKAVAK
``` gi|163940835|ref|YP_001645719.1|hypothetical protein BcerKBAB4_2902
[*Bacillus weihenstephanensis* KBAB4]
(SEQ ID NO: 179)
```
MKSLYAIDAGIGFTKRAYRQDVDSEMTIKSEASTLAPVPNHAESEDLTKVSFIDLDFAYY

MGNEAHQSDASFLPPFDEEIENYYESERFKQQIFGCIAKDYKENVVLPLVVTGLPVTCFG

SQHEQLQNVLKKETSVQIDGKFINITVENALILQQPVALHAYFLKEGIIQERDRILIIDGGF

RTLEMTDMKQNVILNHYETELGCSKPLKNIKNILQNHAGESNHLHINDIPKILEKGYGGR

EKNYQTSQVNTLIQKELDAHFQDVMRVLQEQFKLDQYDTIIWTGGIVDIHKKRIEKMQG

EISSFRMVDASKEAALHGYYIIGSQVFEDITNQSAYESKL
``` gi|17232583|ref|NP_489131.1|hypothetical protein all5091 [*Nostoc* sp.
PCC 7120]
(SEQ ID NO: 180)
```
MFVPANVKQMSIEQVRGGVFEARATDPLMDLWLEYQGKGYAVGQLAADFGANLGVG

QSKVEDALIKVLASAGYFKLKDEISVVLGLPFLSLEQFEREKAQLTSQVTGPHVLNFRGE

SVSLNITKVWVMPEGYGSLLWSEAQPKKGGASPDFTKISTAIVDIGHQTIDLLMVDNFRF

ARGASKSEDFGMNKFYELVAAEIDGADSQSLALISAVNKPKGERFYRPKGASKPTNLDD

SLPNLIEQFSREICSRVLAWLPERVTDVIITGGGGEFFWEDVQRLLKDAQISAHLAAPSRQ

ANALGQYIYGEAQLSSNRAARA
``` gi|17227425|ref|NP_478476.1|hypothetical protein alr8051 [*Nostoc* sp.
PCC 7120]
(SEQ ID NO: 181)
```
MINIYCADIGNYSSITALKGEKPRVMRSVIQDVTYTSARDYDSDNSPSVKLDDKVLVLG

DRATKQKNSQTAAERGKDLPEFFKPFTLAGLRQDFDGIVRFLVPEHSQWHEDTIRRTLV

ADHQITVNGTNYRHRIKNVEFFLETDVAVVNAYRNGKLDMDGDTLAIDIGGGTTNYVV

ITPSLDVLTRRSIPKVGGVSLANDIINSDLMQSFAKRDNVAFKVAKMMDAIADASFIYGR

KYDFSSVFPGLLENWFNNLMDSISTAANDYLADITNVMLIGGCANLVRQKLSSKQGFYI

PANPQLSNIQALLAM
``` gi|17227470|ref|NP_478652.1|hypothetical protein alr9005 [*Nostoc* sp.
PCC 7120]
(SEQ ID NO: 182)
```
MTDLAEMPENALPRHQGTLTLIAGYDLGNSGVKFVTSDRKIRFPSYLENCYYRPTELPTE

GYVEYLEGDAITKLDYKQWLSGYAAYDANPKNHLRVTDDATAKVTQSLKHLLAALSN

YPYKPVINLIICASLHERGDLEEQLIDAIAGKHIVKFGGKPIPTTVNIHVLKVYDEGHAAIA

ANAHTLDTSKQNVIVDIGNRTVIATLIGQKGHLANRKTFDNGVEELIRMISVNPTFKNRL

YGEIAIPHLIRQGLESSEKPFWYGKQFSFEDVYRQELMPWVQKSLAPVFKFIHPWKINAD

ACLIIGGGSQLPSVDEALKAKGFVIAENPLWANAEGLYQLATMMYSRGIDE
``` gi|23100549|ref|NP_694016.1|hypothetical protein OB3094
[*Oceanobacillus iheyensis* HTE831]
(SEQ ID NO: 183)

MTKSRIAAVDVGNDALKGNYGKLENELYIPNVIAPDLEERPVIGIEELDDKEILENIHIRIH

SPALSENNLIYRVGSLATKTTNSQELDQGSSKSEEDQTLIMLLTSLALDAVSASDFEEKN

GVIDANYTLGTGLPLREVKEGKDVAYRSHLLSSVHQIEFLVTPKYQGKKVNIKFDEVKV

YPEGFAAYVNLIMDNDLKVINKDIIDKQILIQDIGGLSTDIAVIRNRNVDDDKAQGFNLG

VSESLEQIREEIRTKHGVELDSRRDVVDIITRKNDRNHIMVKGSRTNVHDITDHILLELAK

KEYRYLRNVWAKNSQSEICYFVGGGSAVLKDYIKALNNKLDGYNIEFFEDENESIWMM

ANAYYKLITDFVQKSSPQVVEKEKKTTKSK gi|21233912|ref|NP_640210.1|rod shape determination protein [*Proteus vulgaris*]
(SEQ ID NO: 184)

MELLRKGRSFGGLFLIKGKVMNQSERFIVGLDIGYSNVKVACGGTQLLDPKVTIFPAYA

TPEPESDLALAKKSPDEVKVYPNGTEWRVFTNRVGHRELHESYHSTEMYKALFYGALI

KATEGRSDVIDILVTGLPVRIANSEADRSQLCESFTGKHEVTPGRFILVKEVVVLSQGVGI

MNDILNTEGLISDEDLEFSNILVIDPGYYSMDYVTFHRGDKKNEFSGSSLNATSVIIEEIVR

VLERDYPKEGAQETERIETALRLGNKTFNNGFRSVEIEPLIEEVSHRIVSSVVAELLKRTR

SIGPVHIIISAGGGARFYDHFIKEAFPQARILQSVNPVASNSIGYWHYGVNKLSSQSD gi|27228647|ref|NP_758697.1|hypothetical protein pCAR1_p156
[*Pseudomonas resinovorans*]
(SEQ ID NO: 185)

MQLQRLGFCRCGVSCVAGSSASSFGALLLSFFAGSGIRMGNALGLDIGYSNVIGVFGSG

DGQPESIIRPSQAAPLSVLPGDSGLRPGEVIVEVDGAPWVAFAAPGRVQDGRELHEDYTS

SHAYEALFKGALLHAAGDKDVIDCLVTGLPVSQARDKPYVEALIKRMTGTHRITPKREV

TVKRVEVVAQPIGTLTEIYCNSDASEVIEESVSIIIDPGFFSVDWVVFDHRELVVNSSSSSL

KAMSVVLEACNEEIAKDHGGIPGVEKIEHALQSGKSYILIYGRKVELAEYLERAAERVIP

SVFTEIKQGLRFLKGRAIDCVILGGGGASLYEPFARKEFPDALVVKPVNSVKSNAEGFW

HIARS gi|32469309|dbj|BAC79052.1|hypothetical protein [*Vibrio cholerae*]
(SEQ ID NO: 186)

MFVLGVDIGYSNLKLAIGQSGSEPKTIILPAGAGPADRMPERIGGGDDETCLYVSVDNER

WAAGVPAGRLQGWERELHPEYPTTKTYKALFHAALLMAETESIDLVVTGLPVSQFHEP

QRKSDLVQRLKGVHQVTPKRSITVHDVKVLPQPAGAYMDLVQTGGDLGLIEEGRVVVI

DPGFFSVDWVALEAGEIRYSSSGTSLQAMSVLLETIDKLISEDHGAKVGMDRLEKAMRT

GDLQVLLFGEKVDISPYLNAAMKKVAPVALTAMRQSMRDESINADLVLIAGGGAMAY

KEAAKEIFSRSKIIVPEQSVLANVRGFWFYGA gi|51894421|ref|YP_077112.1|hypothetical protein STH3287
[*Symbiobacterium thermophilum* IAM 14863]
(SEQ ID NO: 187)

MERLIGVDLGYGFVKATDGREGYLFPSVVGDGSPYLPLRLASQETDPTDNLRVQIGDRV

YHVGTLAVRQSRMAYGFLSVMRDEGNDLLVLFLTALSLFASEANTTFSVVTGLPPGRM

HLADQFVRSVRGDHRVVRYRTGNPEELYLRVDRVTVVPQPLGTYWSQVLDARGQLAQ

QHPAADARVGIVDIGFRTTDLVTVEGGEYVPEQSRTVPTGLSAAYGAVANALLREYGIE

RENHALDEAIISGEIGVSGRRVDITGLREKAFEQLATKVLVEIRSTWQVADYDFLWFTGG

GGLALQRYLVPQFSQASLIADPLTANSREYLAWAHYIYGTGGAPWLERTPVNPQPRQG gi|58616178|ref|YP_195307.1|hypothetical protein p1B50 [*Azoarcus* sp. EbN1]
(SEQ ID NO: 188)
MQRTIIGLDIGHSSVKVVASSSSGRHQFLFPSVAIPAFAISDEGEARIAATETVAVGQRKF

FVGETALVQSCGQPPALGLTNDWIETPEHSALIAGAAKKLERLGLDLRNCLVVTGLPSA

LHTHQKARMREVVRQQIQAEVLVAPQPFGPLQTLMLTPAGTLSSAHDMCEENWAVVEI

GHFTTDFLLIQSGRIVEKASGSCGGVRLAVEHMQRLLNQENIQVDHFEAEQALRERRIKY

FGKALDVTEYAKQAISLIASEVMDTASRVLDPVARKLDGILIAGGGAPVIFPELSLKWPH

ATIANEPRMAIAEGFCRFGMSISAKTQGAKEPAAA gi|182625447|ref|ZP_02953219.1|putative ATPase [*Clostridium perfringens* D str. JGS1721]
(SEQ ID NO: 189)
MLKLGIDLGNGYTKFKGSKFASKTKVGRLASLAGLGEKPKDIHEVGYKGTTYIVGDGE

VFTSPDRYFGLDYEICLLTAIGLSSKDIVIDANICVGLPIIYFMSETKVLLEKKLNELTEKD

SIKITINGQDKIIKINNARVFAEGAYVLDCMDTDNIITIDLGAGTVNITQWDNLIPISYDTIT

KSFNKLYRDIANHIKNTGRGVVTPAYIEANFGEDTITIDGKVVDITDTKQMISKYVSAIVS

NVYDICDVPQANKIQIFGGGAIATEEYWKDAFGKDRDGVSVLPNSQYTNSKIYQKAAEI

LK gi|89894855|ref|YP_518342.1|hypothetical protein DSY2109 [*Desulfitobacterium hafniense* Y51]
(SEQ ID NO: 190)
MFENDILVAGGDPGFGAIKLDAGDTKVLFPAVICKGNERIFSALGNGNVSRGTDEEMQT

GSLDVIVTNHSTGVSRHYFMGSLAESLNPNEAHYCWDEDKSTDEEATALLVVALAVAQ

KEPKANIYLGTGVPVKYYAALKDKYEAELKGTWSVAFRSGPFKGQTRQLTIIRSRVLPQ

SYGVFIKETLNEYGIPISPKLFNGYVVVIDPGFRTTDVATFYDGVMLDPPNSFSIEKGLKW

AYTGVAEQLKEMTINHANPIETDDKELDKVFRVNEGMYPWNNGAINLNPVMQDMLGQ

LGTDISREVKKSLKPMLGKIHTVLVAGKVGEMIFEHLQFENKVLIENPQFGNATGFRIMA

ANLVNNITKKANAAP gi|15894444|ref|NP_347793.1|ATPase of HSP70 class [*Clostridium acetobutylicum* ATCC 824]
(SEQ ID NO: 191)
MITVVDLGNFNIKYKSGSNQGNFSSKITDYQPYPEGFERIQMQGESKITYLGVGELNKEF

NKVARNYLPQLLYAICRANNYDNIETNLVTLLPIVQMKNKEKMIENLKEKEFNFQFNGE

KRKVLINDTIVLPEGYATYFSLSEEDKESSLCIIDLGSRTINICVLQDGAIQLLHTIKLGSFD

FYTKVKTRENSKGEDYTEEDIPRLVENGTIEISDIEYEDFLTEVLNEVKAYVNLKTYKVI

WTGGTALMLKEQIEKLPLNNSKLHNDPLNSNTNGAAGAAEIIWQSEEE gi|15004829|ref|NP_149289.1|hypothetical protein CA_P0126 [*Clostridium acetobutylicum* ATCC 824]
(SEQ ID NO: 192)
MNIKRFNADFGNSTGNFLIDGYYFEIPTNIVEISSKKAEGMFVSPITEKNELLDRLMISTGE

KENEKFYLVGEFAQGHEIKTHVNQMNDKLTSIIPYANFLGAVAYYAILKNPSEEKEINVE

IDNMKMMLPIWILKKASKFSVAQNQMAARFLGEHTVKVLTMGMERIIKIKVNNSVCKIE

SEVARYAIKYKMVQEDKIIKILPRANLSDKFTKCETVLCDFGGGSIDCVKLGEGLTPPKA

RDSFKVIDIEPFLGWLETFRKEKVLQYFYSIKQIEKFLINNYKKQKYILEDPNTGKSYDFT

SKFTEMLQDYSDKLVPVIFNTFKETDRLLKFVYFGGESPVLKPYIKKTLLKFVTEKVAEE

NHIFLDDLLENDTSEVFKPTSRTINLTALELLSISEVTKNKSSEKNE

-continued gi|20808451|ref|NP_623622.1|hypothetical protein TTE2052
[*Thermoanaerobacter tengcongensis* MB4]
(SEQ ID NO: 193)
MNIGLDLGFGYVKGVNSQNKRIIFPSIVSIGFDRPLAGIFNTNDIIENLHVKIVDKDGENSY

YVGNLARREGFSNSFALDIDKYTEPEAKALLSTAIFLLTMNENEPINLVTGLPLKQFQAY

KKAFEEELKNYKALVSLPEYRLMKTVEFEKVTVFPQAAGAVYYALLEDLDKYLLSDSYI

VLIDIGFKTTDYIVFFVEDRPYFLADLSGTIDAGISKIFTAMEQIYTAKTGSNLDTGDFITIL

NKGSIYFKGKYIDFTEEITALKKELAKLIEKRIYTSLKGILDKVMVIFVAGGGGADLYPYL

KDVHTSVELVKDAQFANALGFLKVAEIQK gi|30021240|ref|NP_832871.1|hypothetical protein BC3130 [*Bacillus cereus* ATCC 14579]
(SEQ ID NO: 194)
MKSLYAIDVGIGFTKRAYRQDVDSEMTIKSEASTLAPVPNHAESEDLTKVSFIDLDFAYY

MGNEAHQSDASFLPPFDEEIENYYESERFKQQIFGCIAKDYKENVVLPLVVTGLPVTCFG

SQHEQLQRALKKETSVQIDGKFIHITVENALILQQPVALHAYFLKEGIIQERDRILIIDGGF

RTVEMTDMKQNVILNHYEAELGCSKPLKNIKNIVQNHEGESNQLHINDMPNILEKGYEC

REENHETSQVHTLIQKELDAHFQDVMRVLQEQFKLEQYNTIIWTGGIVDLHKKRIEKMQ

SEISSFRMVDASKEAALHGYYIIGSQVFEDITNQSAYESKL gi|30263107|ref|NP_845484.1|hypothetical protein BA_3174 [*Bacillus anthracis* str. Ames]
(SEQ ID NO: 195)
MKSLYAIDVGIGFTKRVYRQDEDSEVTVKSEASTLAPVPNHDESEDLTKVSFIDLDFAYY

MGNEAHQSDASFLPPFEEEIENYYESEQFKQQIFGCIAKDYKENVVLPLVVTGLPVTYFG

SQHEQLQRALKKETSVQIDGKFIHITVENALILQQPVALHAYFLKEGIIQERDRILIIDGGF

RTLEMTDMKQNVILNHYETELGCSKPLKNIKNIVQNHAGESDHLHINDMPNILEKGYGG

REEDPQTNQVHILIQKELDAHFQDVMRVLQEQFKLDQYDTIIWTGGIVDLHKKRIEKMQ

GEISSFRMVDASKEAALHGYYMIGSQVFDDITNQSVYESKL gi|42782222|ref|NP_979469.1|hypothetical protein BCE_3167 [*Bacillus cereus* ATCC10987]
(SEQ ID NO: 196)
MKSLYAIDVGIGFTKRAYRQDVDSEVTIKSEASTLAPVPNHAESEDLTKVSFIDLDFAYY

MGNEAHQSDASFLPPFDEEIENYYESEQFKQQIFGCIAKDYKENVVLPLVVTGLPVTYFG

SQHEQLQRALKKETSVQIDGKFINITVENALILQQPVALHAYFLKEGIIQERDRILIIDGGF

RTLEMTDMKQNVILNHYETELGCSKPLKNIKNIVQNHAGESDHLHINDMPNILEKGYGD

REENPQTSQVHTLIQKELDTHFQDVIRVLQEQFKLDQYDTIIWTGGIVDLHKKRIEKMQD

EISSFRIVDASKEAALHGYYMIGSQVFDDITNQSAYESKL gi|83589213|ref|YP_429222.1|hypothetical protein Moth_0345 [*Moorella thermoacetica* ATCC 39073]
(SEQ ID NO: 197)
MLAIQTNPQPAALAIDVGFGYTKAVSSTGGKVIFPSVVAPAGSPDAFDRLDKSDTGYRV

RIKKGIDGLLEEWLVGELALKEGREVQYFQDWEKHSHPAHDAVLLAAAVLTWNWPRA

GSGIMGISNPALVVGLPVDVWRDELQREGLKKHLAGLAAEVSVNGNDPVRVTFSRVYV

YPQAAGAFLTVPDLPDSGIVALVDVGQKTTDSAAIEIVNGRQRLVKTMCFSINKGMAAL

VEAVREEFRRQTGAPLPPQQAWETVKSGSLWYRGKQIDMAPAIKKARSEIARAIADQVL

AGWGERADFVRKVYLAGGGILDLPDLKNMFPAAAVLGPQWANALGFLKVARGLAV gi|52142376|ref|YP_084454.1|hypothetical protein BCZK2867 [*Bacillus cereus* E33L]
(SEQ ID NO: 198)
MKSLYAIDVGIGFTKRAYRQDEDSEVTVKSEASTLAPVPNHDESEDLTKVSFIDLDFAYY

MGNEAHQSDASFLPPFEEEIENYYESEQFKQQIFGCIAKDYKENVVLPLVVTGLPVTYFG

```
SQHEQLQRALKKETSVQIDGKFIHITVENALILQQPVALHAYFLKEGIIQERDRILIIDGGF

RTLEMTDMKQNVILNHYETELGCSKPLKNIKNIVQNHAGESSHLHINDMPNILEKGYGG

REEDPQTSQVDTLIQKELDAHFQDVMRVLQEQFKLDQYDTIIWTGGIVDLHKKRIEKMQ

GEISSFRMVDASKEAALHGYYMIGSQVFDDITNQSVYESKL
``` gi|75908582|ref|YP_322878.1|hypothetical protein Ava_2365 [*Anabaena variabilis* ATCC 29413]
(SEQ ID NO: 199)

```
MTDQPSAATPMNAAAIPLNRVSASTPINAAPANNKPNNGSSKSILSVDLGRTSTKTCVSR

EPNNVVFVPANVKQMSIEQVRGGVFEARATDPLMDLWLEYQGKGYAVGQLAADFGA

NLGVGQSKVEDALIKVLASAGYFKLKDEISVVLGLPFLSLEQFEREKAQLTSQVTGPHVL

NFRGESVSLNITKVWVMPEGYGSLLWSEAQPKKGGASPDFTKISTAIVDIGHQTIDLLMV

DNFRFARGASKSEDFGMNKFYELVAAEIDGADSQSLALISAVNKPKGERFYRPKGASKP

TNLDDSLPNLIEQFSREICSRVLAWLPERVTDVIITGGGEFFWEDVQRLLKDAQISAHLA

APSRQANALGQYIYGEAQLSSNRAARA
``` gi|270208508|ref|YP_003329281.1|hypothetical protein pCD01p15 [*Lactobacillus paracasei* subsp. *paracasei*]
(SEQ ID NO: 200)

```
MEIFSLDLGNKQTKLKSSKSEYVLPSRYLNQADMPMSVGSSTTNNDLHIYSVPFSDDKY

VWGRDIDGLHLDEYLADTIMYGNRYNSEAFKLLANFALGLLASDFKIANNQVLEVVVT

AGLPTGDYADQERLRSLLKVLEGQHQVTIDDQIVTVRVRKVYILPQPIGTLYNELLDDQ

GFIKNKALLDEKVGIVDVGGGTILIDTILNFELSGKNRQQFNTGVNDLYEAIASRIEGDVS

LYQLEKELRHGNQQHQWSYRFSKNRQDDITELVGKESDRFTRRLVANVTSTLKNLDSID

TLFFTGGGANLINQKILKTTFTNAAIVKDTEVANVNGFYKYGLSQQVQEKEGK
``` gi|71907839|ref|YP_285426.1|hypothetical protein Daro_2217 [*Dechloromonas aromatica* RCB]
(SEQ ID NO: 201)

```
MELIVRAVDVGSGNTKFVTAAAGTDIRCASFPSVAYPSSDDSPSWPASERKKTVCIPIGP

LFYEVGPDVSLAADTFRAKQLHDEYTETPEYMALLRGALSMMKVSHIDLLVVGLPVAL

FTVKKSALEKAMTGRHDIGNNKVVTVGKAMAVPQPQGALVHYASEHQKMVEIGNEQS

LIIDPGSRTFDWLVARGMRFVQKQSYSFNRGMSDVLRLLAAEITKDIGSPYRDYDAIDLA

LRTGKQPLIFQKPYDMKRLLPLAETVAEQAVSTMKEWIEAPHSLQNIILVGGGAFLFRKA

VKAAFPKHRIHEVKEPMFANVRGFQLAGQNYARSKMTATDRGQVQGASGELE
``` gi|71908146|ref|YP_285733.1|hypothetical protein Daro_2530 [*Dechloromonas aromatica* RCB]
(SEQ ID NO: 202)

```
MLAARKSIEEPHMDYIVRAVDVGFGNTKYVSNVVGSDIRCTNFPSVAYPSMREPSGQPG

YERRKTVAIPVNGLFYEVGPEVELAADTFRATQMHDRYTETPEYTALLRGALALMKQP

EIDLLVVGLPVAALTTKKTALEKAVTGTHDIGNGKNVVVRKALAIAQPQGALVDFVEQ

HGKTTTIEREQSLILDPGSRTFDWLVARGMRLVQNKSHSVNRGVFDILQAIAAEIGHDIG

TPYNDIEAIDLALRTGKNPVIYQKPYDISRAMPMAHSIAQQAVASMMRWIDASYSFQNII

LVGGGAYLFKKAVKEAFPKHRILEVKDPLHANVRGFQIAGMNHVDKLFSGTATATHGGA
``` gi|77164147|ref|YP_342672.1|hypothetical protein Noc_0623 [*Nitrosococcus oceani* ATCC 19707]
(SEQ ID NO: 203)

```
MTELTDEKTTDQRQASIADDPMQVVQVGLDDGYAYTKVALPDGRLVSVPSRARMGAA

GVTWIRDVEQRIFEYETAGTVYSVGAVDGEPTQFDEYPGSALNRVIVQHALQEAGLSGR

SLHLVTGLPVAAFYRGDGQQRRQAIQTKRDGLKLTVEPVVAKKSSTRQALKASIAFHEV

IPEALAAWYDFVIVTLDDGVTLDADRLNAPIAIVDIGGRTTDYVVVQDQGVVHGSSGSL
```

NRGMLDLKLRVANLIQERFDLHELGEQIISRAVDTNRLRLHGKDHDVSDMVMNAKREL

VERLYAETRRKLGLGVELDRILFVGGGSAALSSDIADWFPNQTIADHAAFANARGMLK

YLQFVCDDASKER gi|83814376|ref|YP_444614.1|hypothetical protein SRU_0469
[*Salinibacter ruber* DSM 13855]
(SEQ ID NO: 204)
MFKTKTLPSVFEASNAELVDVSDSLLTGLKIGHNGRSYVVGELALLEGNAPHKGINNAP

SDLDYRLLLQAALAVTKAGAEEPMYVTTGFPSSTYAAHRDTAEELVKGTHVIDLDGRT

FGKSPDTSIRVEVDQVEIIPEIEGFTFGVRQGEPRERDPFFAVGLGYGTMEAALSLPSGIV

QRTTASASGLQYATQLMSDRLQKEHYLDMVTEHQLDMAMRKGSIVIGRKKMDLTEMR

QDVLSTYYEDIVSPTLKRAFDDADFGRARKMYVGGGGALFDELVDAFTDEFGDVLSLE

VVPNPASFISQGYALHAADANGGHRARAVGLDIGNANTVINLLREESV gi|85859495|ref|YP_461697.1|mreB-like ATPase involved in cell
division [*Syntrophus aciditrophicus* SB]
(SEQ ID NO: 205)
MQMNLGLDVGYGDVKAVYQREGILEMLKFPTAIAYAEREVGDLSAFAGGEEYEYRGR

KYFVGREALVGAFSTRSFEFMKRYSPLFVFKAVKKIHRRTGELVTDVAMGLPLSHYTEA

NLKELVPLLQRIEVGREVLELNARFYPQGLGVLADYRLSQAGDVNARTDRDMIILDIGF

NTVDVIVVERGRIVKGESDTLERHGVSKISLDLAREIKVRMQLDLSEQESKDVLRQGRIR

VYGAERDLAELVRESAEKYMDWLIQEVHSKWMARIQRAEKVIIAGGGAYYLQEHIPEE

YLPLVHVPDHPEYANARGFLKALDVESGK gi|157502129|ref|YP_001485228.1|hypothetical protein pBMB67_042
[*Bacillus thuringiensis*]
(SEQ ID NO: 206)
MVEQMLSKNMLLGGFDTGNIKAKISFLNEKGNIESFAIPTVIAEAPPAKIDLKSAPSKKN

DYVNEKDEDIELLHVRIISNSLDGDARSRAWYVGAYAKDQEDRQEPTVDEMGKTEDKF

SQKNKKLHLIPLFTSMAVAAARIGKEEVSVPFSGGMPIEDYKLRGEEQILEMLYGEHTVE

FLDGTYEGKKIKITINDGTMNVEGVSSVLAILFDIVNGEIVEVEGMDAEIGESYAINDLGA

GTSDNAFFEDGELNKKLSTNTDLGTNKYIDEILKNIKERFMENEILKSFMTDEIESPFKTR

EDFIQRLVMPEVEKMIEDDTYKPTFSVKWGPVKENVTDIVMDGMLKYAEDQKASLMK

FWFKTNADKNIVVGGGVLFGYAGLRDLKEQDGFILPKNIQESAYFTSRSYLIANLLEQLN

KEGVEA gi|49479525|ref|YP_037246.1|hypothetical protein BT9727_2923 [*Bacillus
thuringiensis* serovar *konkukian* str. 97-27]
(SEQ ID NO: 207)
MKSLYAIDVGIGFTKRAYRQDEDSEVTVKSEASTLAPVPNHDESEDLTKVSFIDLDFAYY

MGNEAHQSDASFLPPFEEEIENYYESEQFKQQIFGCIAKDYKENVVLPLVVTGLPVTYFG

SQHEQLQRALKKETSVQIDGKFIHITVENALILQQPVALHAYFLKEGIIQERDRILIIDGGF

RTVEMTDMKQNVILNHYETELGCSKPLKNIKNILQNHAGESNQLHINDMPNILEKGYGG

REENPQASQVDTLIQKELDTHFQDVMCVLQEQFKLDQYDTIIWTGGIVDLHKKRIEKMQ

GEISSFRMVDASKEAALHGYYMIGSQVFDDITNQSVYESKL gi|89885972|ref|YP_516170.1|hypothetical protein Rfer_4487 [*Rhodoferax
ferrireducens* T118]
(SEQ ID NO: 208)
MGLFPERLYQTARIEQVQHTTVFMSKTPPTFRALDLGFGFTKFSKGHYLQDGSLEVSAFP

SYAAAAVNFSIGAGVMTDLSIVKVSVDDEHFLVGEDVRNAADGVGRQMLESTFFTSSQ

YIALARGAMGFMNVPNHGEVDSLVMGLPLNIFRDQSIVDHVEAAMKGTHLVPDITKNS

GVERTILVKNVSIIPQVVGSLVAMSRDAGLMQKVNEQHNLTIDVGYGTLLWLVSDGFTP

```
VPARSNGNMGGVSSLLQKIIRSIDPSAVSSINIMDRLDKALLEDKASILINGAEVEVAKYH

RQLASAARENLTEMIRSIGTKADIDNVFLTGGGAHLYKDAIAAVFPGRQVHIASKGSRFT

NVRGFQFLAETED gi|90962843|ref|YP_536758.1|hypothetical protein LSL_1868
[Lactobacillus salivarius UCC118]
                                                   (SEQ ID NO: 209)
MSKNNILKLNVANDLGYGSVKAKVEDTNIHFPSVIAIQREQDLNKPVEFNSNQEKLTYL

EGMINHMDVTISSSAVKTQGRFLVGNAAIKSSLPLKAFDVNDFTGKSDNDLAIILTLSMI

AAQRISLAVKNGEDLSDQLSTEINMTTALPVSEGKKNGIINNYVNKYISSKHTVVFHNFK

DPITVSLNFKNVYVALEGEVAQLYLKNSDIKLQGLIKQDFSKNYPELANDIKVSDLVKID

NLLGIDIGEGTTDLVVIKEGHANAVASTSLPTGYGNALQDAIDVLQTENMNFEARSQLQ

DYLAQEVSPLAKRMQTKVRQIVFEQLEPFADKIVTAASKTMRKAGANVEILYVYGGGSI

PMLEQTALRQKLSQKMKDFSGGIDVPVIWINKSYAQNLNEKGLELILKAMNK gi|91791236|ref|YP_552186.1|hypothetical protein Bpro_5434
[Polaromonas sp. JS666]
                                                   (SEQ ID NO: 210)
MPEIVAIDLGYGHTKVVSQGRDGEIKRMIFPSVAPITTRERTAESNGMGALRTVTCVG

ANNYVIGKDAYLEADSNYSRSRLDEYSQTDGYHALMLGALALSGLREIDQLVIGLPLTT

LDTYHSVMSSKYLGEHSIGATYARRKVELAVRNVLVTSQPAGAMINAVAGQPGLKKAT

NLAIDMGYFTMDFLMCEGLRPFYKRSGAVQGGMSGYYDHLNGMVAEKITSEGLPAQS

TVDHFRLEETLSNGIQGENGRTIYSLRIGKLEVDITECVERASTRLTEYLDRMMTTLGGG

SSMGIISSVVLAGGGARMILPAVKERFGKTHDIVMQDAAQYAIANGFLHFGLASAKRAA

AQV gi|91790780|ref|YP_551731.1|hypothetical protein Bpro_4960
[Polaromonas sp. JS666]
                                                   (SEQ ID NO: 211)
MKPETPMVDVRAVDVGYFSTKLTLARNLEGNASTIASMKPETPVVVDVRAVDIGYFST

KLTLGRKLVGNASTIATALFPSLAPRLPASMSMQTALHGKPDGSVVDVDDVNYFVGRD

AILYSSGREPREVLADYSMTDKYHALMRGAFHYIAQDAKATSELVIRHLVMGLPLNTFG

ENRDRLAARATGEHLLPDPSNPGSMRRITVEKASVIVQPQGALVSYGTTHREIFKEGWV

LVVDPGGGTLDWYVARGRLPNWQRSGAYPKSMLACAYAVADRIDPTWRDNFEIIERID

KAIRDKAPSFMTAGNTYELAPYTSAIEAVLKESTDKMVARLGSLDNLDLILFTGGGAKV

YFDFFKSRNPKLTNIMFMDDDPVFSNVKGFHVAGEIMSKSRTI gi|153822523|ref|ZP_01975190.1|conserved hypothetical protein [Vibrio
cholerae B33]
                                                   (SEQ ID NO: 212)
MFVLGVDIGYSNLKLAIGQSGSEPKTIILPAGAGPADRMPERIGGGDDETCLYVSVDNER

WAAGVPAGRLQGWERELHPEYPTTKTYKALFHAALLMAETESIDLVVTGLPVSQFHEP

QRKSDLVQRLKGVHQVTPKRSITVHDVKVLPQPAGAYMDLVQTGGDLGLIEEGRVVVI

DPGFFSVDWVALEAGEIRYSSSGTSLQAMSVLLETIDKLISEDHGAKVGMDRLEKAMRT

GDLQVLLFGEKVDISPYLNAAMKKVAPVALTAMRQSMRDESINADLVLIAGGGALAYK

EAAKEIFSRSKIIVPEQSVLANVRGFWFYGA gi|38637991|ref|NP_942965.1|hypothetical protein PHG330 [Ralstonia
eutropha H16]
                                                   (SEQ ID NO: 213)
MSTNTIAVDVGYGNTKFAFPLGADVAASMFPSLAPTRSASSLASHGGGYFQARDVVHV

TVDGAEYEVGPDVSITSAYGNNGRTLSEDFVTTPEYAALLFGALHYSQARDVGQLILGL

PVHTLQKYAGALQERFTGAHDFGAGDVTIKRVVALPQPLGSLVTFMRQSGKELDPDDN
```

-continued

CLIVDVGYFTTDWVVARGYMMDDTRSGGVPGGSSRIYKQVATLLSADEGGEPTGDIERI

DKALRQGKLMRYYEKMVDLRPYFEVAKAQCQMAVKEMQTRVGRTEDIAAIVLTGGGS

ALYSGAIRAAFPRSHIVAMDSPCFANVRGFFDIGSARQARG gi|190015749|ref|YP_001967754.1|possible plasmid partitioning protein
[*Clostridium perfringens*]
(SEQ ID NO: 214)
MILGLDIGNITSIGVGDKEDFITESRLREFEELDDFSGNDIVEINDKKFIFNEGYFENNVVK

HEKENFINLLYYTIAKTLDKENSKENDVKIVIGVPAGQYNSEKERLKKVILNNQCKNIKI

NGESRTINIEDIFIAPEGYGAKVEALQAKKEKVKLLMVDIGGGTSDAALFDENGRFIGGK

SIKVGLLDLYKNVQEVLDLKYKLSVSLEDARKYFDGELDIRNEKFEVENTYKTEALNKL

VKFLINELRGLYPNISQYAICLCGGADGRILPVFKKVYIQAEAITDIKANAKGFRKVGLA

KWQNQGK gi|219669299|ref|YP_002459734.1|hypothetical protein Dhaf_3280 [*Desulfitobacterium hafniense* DCB-2]

(SEQ ID NO: 215)

MFENDILVAGGDPGFGAIKLDAGDTKVLFPAVICKGNERIFSALGNGNVSRGTDEEMQI

GSLDVIVTNHSTGVSRHYFMGSLAESLNPNEAHYCWDEDKSTDEEATALLVVALAVAQ

KEPKANIYLGTGVPVKYYAALKDKYEAELKGTWSVAFRSGPFKGQTRQLTIIRSRVLPQ

SYGVFIKETLNEYGIPISPKLFNGYVVVIDPGFRTTDVATFYDGVMLDPPNSFSIEKGLKW

AYTGVAEQLKEMTINHANPIETDDKELDKVFRVNEGMYPWNNGAINLNPVMQDMLGQ

LGTDISREVKKSLKPMLGKIHTVLVAGKVGEMIFEHLQFENKVLIENPQFGNATGFRIMA

ANLVNNITKKANAAP gi|121593973|ref|YP_985869.1|hypothetical protein Ajs_1600 [*Acidovorax* sp. JS42]

(SEQ ID NO: 216)

MELIVRAVDVGSGNTKFVTGVTGTEIRCASFPSIAYPSSGETPQWPASERRKTVCIPVGPL

FYEVGPDVGLAADTFRAKQLHDEYTESPEYMALLRGALSMMKVPHIDLLIVGLPVALFI

LKKAALEKAVVGSHQVGGGKTVTVAKAMAVAQPQGALVHYAAEHQKIETIGTEQSLV

IDPGSRTFDWLVTRGMRLVQKQSHSINRGMSDVLRLLAAEISKDIGTPYRDFDAIDLALR

TGKAPVIFQKPYDMKKHLPLAESVAQQAVSTMRQWIETPESLQNIILVGGGAFLFKKAV

KAAFPKHRIHEVKEPMFANVRGFQIAGHNYAASAMASGRDRGAGEAV gi|110804060|ref|YP_699969.1|putative ATPase [*Clostridium* phage phiSM101]

(SEQ ID NO: 217)

MILAVDLGNYNIKTSENILFESRYEEVEKEDFDTDLLEFDNKSFRMESGDFENEFNKAKK

QYIPNLLYAIAKSCDKNKVEIDLVLGVPASNLGISENFKTELSDREFKFTLFGTKKVVKIN

KVATVAEGLSSFYTLPKEERLKDIVLLDIGGRTINVCTFTGGKCSLKFTVPGGMLDLYSQ

IQEDYNKVGNNADVEEIIRLIKNDTIDASNAKERFVKSQLNKIRLQVPNFSTYKVYLVGG

GSLELQEALRNQLENINFVPDTVFSNAKGNKLIAKAKWGE gi|121610594|ref|YP_998401.1|hypothetical protein Veis_3667 [*Verminephrobacter eiseniae* EF01-2]

(SEQ ID NO: 218)

MPDVIAIDVGYGNTKPVWSHDPDKSGKERWGEACFPSITPMAMVDEESTGGAYNPDRI

LITVRNKGYYAGPAASMGIEARTLDPDYIESDDHEVLLRAAIHWAMREKRALLPAIDML

VVGLPVSGFSARGKRLRDIALAPRDVPVPRVLQTSGVPAVITVRAKQVKVLPQPFGSLR

YAAQNLPDTDELFSDRALSMVIDPGYRTFDWFVANGMRPEMKLSGSFDGGVSNILRQV

SQKIGYEHGTGSLEFDQVEEGLLRGAINLGYKVIDTRPYQAVVLDAARKEVMAFLGRID

ANKARLRRVFLTGGGASYYKLALAEKLPGYQIQMLDNGLMGNARGFWLSGYDDFDV gi|118443715|ref|YP_879207.1|hypothetical protein NT01CX_0741
[*Clostridium novyi* NT]

(SEQ ID NO: 219)

MSKGNNIVDSFSVQVIDDGYADTKSRGEDTNMIVTPSYVTSWRPSYNKDNDLQEEKIDK

LSRIEVKVNGSKYLVGQCAVKQDRNIQWNGAADKHDDTSFDILLKTHLSLLNKKPMSR

VKLVMGLPVSASLDKERIEKMKAKVLRQHNSALRLYGDKDFQNKIVKVEDLIIKAQPH

GTLCDLILDSSGNLTNKDLARKVNAISDIGGKTHNLYLVDALEPLSDFCDTKNSGMYIA

YMWIKNYIEQELHLNVSDGQIQYIVASGQIKGYDLTPVIQKAYRSLARKIILEIRTVWEN

AFPFIDNIIFTGGGATVLKPYLQEEFKNAMYLTRNQNASGLFKQGIRKWKRKAV gi|118478456|ref|YP_895607.1|hypothetical protein BALH_2828 [*Bacillus thuringiensis* str. Al Hakam]

(SEQ ID NO: 220)

MKSLYAIDVGIGFTKRAYRQDEDSEVTVKSEASTLAPVPNHDESEDLTKVSFIDLDFAYY

MGNEAHQSDASFLPPFEEEIENYYESEQFKQQIFGCIAKDYKENVVLPLVVTGLPVTYFG

SQHEQLQRALKKETSVQIDGKFIHITVENALILQQPVALHAYFLKEGIIQERDRILIIDGGF

RTLEMTDMKQNVILNHYETELGCSKPLKNIKNILQNHAGESNQLHINDMPNILEKGYGG

REENPQASQVHTLIQKELDTHFQDVMCVLQEQFKLDQYDTIIWTGGIVDLHKKRIEKMQ

GEISSFRMVDASKEAALHGYYMIGSQVFDDITNQSVYESKL gi|118478108|ref|YP_895259.1|hypothetical protein BALH_2464 [*Bacillus thuringiensis* str. Al Hakam]

(SEQ ID NO: 221)

MSILLKAGADAGNNGLKLMVKGQDPIFIPSIYALYIGEPTGLLDEEDVSLSELENHIDVTI

SSPSLMLNNVRYIVGEKVIQDQLKGTEVEKKSNKSTDELMVITILSGLAVSAMRQSPTSS

HINIRYDLSVALPMQLITQEIAAENAKRYMGNHKVVFHYPNGRDVTINISIEYCKCLPEG

ASGTWGIVYDEEGNVVKHKIECEQNKVSEIDFVDKTLLSFDIGAGTTEEVVSLGVNFRPQ

LSKGLSYGVKETLLQIITRWNRKYPTKTIDSITEFNQIYLNDKHPRNALLVEESQPALLGL

AARVATDIINKIDDMKDDPYVFIYGGGAVIIKNSLKMILKQKGRLTNVIFVDNPLFTNAR

GLLVYTCSPKYREHKQKELGFTNLTIS gi|172064562|ref|YP_001812212.1|hypothetical protein BamMC406_6538
[*Burkholderia ambifaria* MC40-6]

(SEQ ID NO: 222)

MKTAVFAVDVGYGNTKYAHRAASGTIATGMFPSLTPLAASRTLSGYGESVLTARKVSTI

VIDQVEYEVGPDVPLTAAYGNTGRALADDYVLSDNYAALLFGAIHFSGVTHIERLVLGL

PVHNMKKYSAELKERFAGELDFGAGRVTVDKVVVIPQPLGSLVLASSNRQHEFGRDVA

HLVVDVGYFTTDWVYANGFTMDDNRSGGMPGGASQIYQRIASLVARDQGDEVEDIERI

DKALREQTPFFFYGTNIDLAPYLEQAQPLISGVVKEMQNNVGRLPNVRSIILSGGGAALY

AAVIRRAFPRVLIEVIDAPCLANVRGFLMVGEAGLARERR gi|161522610|ref|YP_001585539.1|hypothetical protein Bmul_5577
[*Burkholderia multivorans* ATCC 17616]

(SEQ ID NO: 223)

MKTAVFAIDVGYGNTKYAYRAATNAVVSGMFPSLAPLAASRSIAGYGESVLTARKVAT

IVIDQVEYEVGPDVSLTAAYGNTGRALADDYVLSANYAGLLFGAIHFAGVDHIERLVLG

LPVHNMKKYSAELKERFTGELNFGAGRVTIDKVMVIPQPLGSLVLASSNRQGGFGRDVE

HLVVDVGYFTTDWVYANGFTMDDKRSGGMPGGASQIYQRIAALIARDQGDEVEDIERI

DKALREQTPFFFYGSNIDLAPYLEMAQPLISGVVKEMQNNVGRLANVRSIILSGGGAAL

YAGVIRRAFPRVVIEVIDAPCLANVRGFLLVGESSLARERR

-continued gi|119493931|ref|ZP_01624493.1|hypothetical protein L8106_27631
[*Lyngbya* sp. PCC 8106]
(SEQ ID NO: 224)
MQSNKQPVGQPAVGPNTIMNRQTTTTTTSSRRTILSVDLGRTSTKACVSRNPNEVVFIPS

NVAQLTVEKARGGGFESENTDPLLDLWLEYRGDGFAIGQLAADFGANLFGGNDTDSPS

KVNDALIKIFACAGYFKMKGDVEVILGLPFYSQEQFEREKEQIISLLMGPHVLLFRADQIT

IDIKSVRVMPEGYGSLIWCEAQKSKETPNFADLSVAIVDVGHQTTDFLTVDRFRFARGVS

QSEVFAMSKFYEEVATKIEGADSQSLYLLEAVHRPAGQRFYRPRGSAKPVNLDEIVPEL

RKKFAQELSSRLVEWLPERVTDVVLTGGGGEFFWEDLQPLLKQAQLRAHLAQPARKAN

ALGQFVYGEAQQVKR gi|119511106|ref|ZP_01630224.1|hypothetical protein N9414_16841
[*Nodularia spumigena* CCY9414]
(SEQ ID NO: 225)
MTDQPSAATPMNAAAIPLNRAANIPINANPATNRPNLGGKTILSVDLGRTSTKTCISREP

ANVVFVPANVKKMSIEQVKGGVFEARATDPLMDLWLEYQGYGYAVGQLAADFGANL

GVGQSKVEDALIKVLSCACYFKLKDEISVIMGLPFLSLEQFEKEKAQLTSQVTGPHVFNF

RGESVSLNITKIWVMPEGYGSLLWSEAQPKTGGKVPDFTKISVAVVDIGHQTIDLLMVD

NFRFARGASQSEDFGMNKFYDMVAAEIDGADSQSLALITAVNKPKGERLYRPKGASKP

TNLDDFLPNLIEMFSRDICSRVLAWLPERVTDVIITGGGEFFWEDVQRLLKEAQINAHL

SAPSRQANALGQYIYGEAQLSVGRATRA gi|187928639|ref|YP_001899126.1|conserved hypothetical protein
[*Ralstonia pickettii* 12J]
(SEQ ID NO: 226)
MKAATVAVDVGYGNTKFAFPMGSETKLNMFPSLAPQAAPRALANHGNGFFKARDVITI

AIDGVEYEVGPGVSLSSAYGQTGRTLSEDFVTKDEYAALLGGALRLAQVSEVGQLILGL

PVHTTQKYASYLRDRFTGTLDFGGEPVEIGSVICLPQPLGALVTFMRQQNTKFDADNAH

LVIDVGYFTTDWVVAQGFTMDDNRSGGVPGGSSKIYQQIASLIEQDEGEPVTGIERIDKC

LRDKKPMLFFDKEIDLTPYLEKARSVCQLAVKEIQTRVGRTEDIRAIILAGGGSALYVPAI

RAAFPRTPIHALSSPCFANVSGFYDIGSTRPVKQK gi|153800418|ref|ZP_01955004.1|conserved hypothetical protein [*Vibrio cholerae* MZO-3]
(SEQ ID NO: 227)
MFVLGVDIGYSNLKLAIGQSGSEPKTIILPAGAGPADRMPERIGGGDDETCLYVSVDNER

WAAGVPAGRLQGWERELHPEYPTTKTYKALFHAALLMAETESIDLVVTGLPVSQFHEP

QRKSDLVKRLKGVHQVTPKRSITVHDVKVLPQPAGAYMDLVQTGRDLGLIEEGRVVVI

DPGFFSVDWVALEAGEIRYSSSGTSLQAMSVLLETIDKLISEDHGAKVGMDRLEKAMRT

GDLQVLLFGEKVDISPYLNAAMKKVAPVALTAMRQSMRDESINTDLVLIAGGGALAYK

EAAKEIFSRSKIIVPEQSVLANVRGFWFYGA gi|125623971|ref|YP_001032454.1|hypothetical protein llmg_1140
[*Lactococcus lactis* subsp. *cremoris* MG1363]
(SEQ ID NO: 228)
MNIFAIDLGNKRIKMKSERGEYSYPSSYLNAEQVVTGGLGSEIIEQNYHFQTIQDSTNSFI

WGPNLEVYNLPERMIDTYARSGRMKQKKTIRIFEFALGRLVMDFPEAFESPLVVHLMLG

LSITDMHQESDTIDMLKKLAVGQHQIIIGGRVVTIIIPSEEFLSIIPQYMGTVLNLAFDQDY

QRNRRFSDGRIGVIDIGGGTILINRSVALNPSPIGDERFEGIQNLIKEIGRRINSTKSFLIEEM

LRSVDSEGNYVYPPNSNVQDSKNVSPIVEGEIERYTRFTVAPLVTENFPDIEEVDFIVVTG

GGASLLAKEALKDEIGEEYFSRLLFLNESEFANVRGFYKGGYLKWHSSNEELAVEARRE

KPAELQESQTRDVIVPPIRNTETSMDRELLEAQQKLQALQSEIDGVQIEFEN

-continued gi|124514596|gb|EAY56108.1|conserved protein of unknown function
[*Leptospirillum rubarum*]

(SEQ ID NO: 229)

MSKTKPVRSPEQEFSEEPVIDVGLDDGYAAIKLAWYGPDGTLRTHSVPSRARSGSLGVG

SLFGDSALSVGGYETEGERFTVSPGLEGEVTRFPDYNLSPLARVLAHHALIAAGFAGKQ

VRIASGLPLDRYFRDGKEGKRKDEHRIARKIESFARPVRRLDGTGTARIVSHSVFAQGLA

AVVDWLVEGTTIRSQKDPVGVVDIGGQTTDISVINPDFQANHGHLKTCDLGVLDVRDLL

GRRIQSSHDVDKISDSALDAALTTGATRIWGKDVSVQDELRDAIREIESRLANEILSVFGK

EASTLETILFVGGGSLVFRNLPTRFPNAAVVDCPEFANARGLLKALSLSGRS gi|126640709|ref|YP_001083693.1|hypothetical protein A1S_0642
[*Acinetobacter baumannii* ATCC 17978]

(SEQ ID NO: 230)

MGKSFRLPSRVANGRTIIGDTDEVNKQIIHVNGKYFTVDEFTKEHIDTRTEDYPLSDANV

ALVHHALHQAFDGQYRKFKIATGLPLNRYYGGKDKAKNEKLIADKTQNLLINKDFNNP

TVYNLYEHDKKNDPLQILNHIVLSEGQCAYFDALMDDNGKRSSMYEDLWEGGCAIIDIG

GRTTDIAMINPRGGTMQASRCDTLDVGIITLKNKVSQNLKEFFGLSSNITDWRLSKALKT

GIYNHGGKDHDISKILNAAKVEITDQIENSIKVNVQDGQDLGAVLLVGGGSITLGDELLK

RFNYDNWHLVKQPEFANARGMYKCAKYISKL gi|126660579|ref|ZP_01731683.1|hypothetical protein CY0110_31855
[*Cyanothece* sp. CCY0110]

(SEQ ID NO: 231)

MSDLTMALDFGSSLGRAIYTTSSSYVKPELLLLDPHVVEVPNISIANYEKYKVGNPSPQD

SSWVNLNDTYFAVGFLAKRQFSTIHCLNSLKIDSAIPLTLAMVGAVAEIKGLGTTFSLDL

GVLLPWSEFKDKDKLKSVLDSALQSFEYRGQQYHVTLQAFDALPEGGGLFARGRVASK

GKPMKRVTETNLVVLMIGYRNASILVVERGELTIGLTSEFGFSQMITKIKTFTSGQSEDVL

IPAICTGKSISDRTLERLARSQRAELREAEKKEIKDAIEDSQQEYVATLTNWISQQIPPHLE

IDEILLGGGTAKYFKRNLTTLLKSYGAQINWSQSLEKRVVQTFGNEVSKNYLASRLADV

YGLFYRLLKKPLPRLKEVVTRESA gi|126667805|ref|ZP_01738772.1|hypothetical protein MELB17_09158
[*Marinobacter* sp. ELB17]

(SEQ ID NO: 232)

MKRPLSIAVDNGYYDHKVAYWDGDVIRTFKYPVVIGSKHEVMSTMDGQLVGMYETEG

VRLVVDPTINNKIPLRYDEYGSSKENRTLVSHGLYKAGVAGGQEVHLTTALPFRDFYNI

DGSLNRPLIDAQKANMLVPVSLVASSDGPLDPIANVTQSRVMSEGVAAVIDYLVRDNSG

QARKMRAPIAVMDFGGSTFEVVTVMPNMNIRHSSSDTMKRGTYDIRTSFAPMLADYLR

ELGFKMKHAADWMVTEAFETGSIEFPGVGIDAGNRVIPVKHIIEEAAKPIVNEIKKFTQA

KLPNMAEYEAILLVGGGGLLTESLFEDWKEEFGLIVVDEYANARGMLKVALIA gi|134044554|ref|YP_001101879.1|hypothetical protein YR71pYR1_0185
[*Yersinia ruckeri*]

(SEQ ID NO: 233)

MSQFVLGLDIGYSNLKMAMGHKGEEARTVVMPVGAGPLELMPQQLTGGAGASIQVVI

DGEKWVAGVEPDRLQGWERELHGDYPSTNPYKALFYAALLMSEQKEIDVLVTGLPVSQ

YMEVERREALKARLEGEHQITPKRSVAVKSVVVVPQPAGAYMDVVSSTKDEDLLEIIQG

GKTVVIDPGFFSVDWVALEEGEVRYHSSGTSLKAMSVLLQETDRLIQEDHGGAPGIEKIE

KAIRAGKAEIFLYGEKVSIKDYFKKASTKVAQNALIPMRKSMREDGMDADVVLLAGGG

AEAYQDAAKELFPKSRIVLPNESVASNARGFWFCG

-continued gi|138898362|ref|YP_001127547.1|hypothetical protein GTNG_3469
[*Geobacillus thermodenitrificans* NG80-2]
(SEQ ID NO: 234)
MKLVVANDIGNSETKMIVNNTLIKQPSVVKRLLSKPNVMETNVEKNIANLLDELIVHVT

SNAIKRSGLYFIGKRANMTADKVENMNIKLGNKSKHDIPVLMTLSMLAARSVQLAYQE

NQELPPSISVDVSMTTAIPASEYSADQARYLEGRFTSNDHVVIVYVGETPVTVTLHFQTV

KVTQEGIPALYALLESENEILKNYNEHYKKQAVPKDFANKRILHVDIGDGTTEYIYTVG

MNPVTDVCSGEKRGVGHATEEATQLLKEEVGGFLNLNRQQFMDIFRDPSHNLHDLAVR

FMQEARYSQAQRILEDIQEKYSDIAGNVDVIAVYGGGSIQFKEELYEELLDFANTVHCEV

LWIPEKYAVDMNVNGLHVINEKILFKQHA gi|145301264|ref|YP_001144104.1|hypothetical protein ASA_P4G053
[*Aeromonas salmonicida* subsp. *salmonicida* A449]
(SEQ ID NO: 235)
MKQFILGLDIGYSNLKIAMGFKGGHVTTTVLPVGAGPLALMPQQLTGGEGNCIQIVIDDE

KWVAGVEPDRLQGWNRELHDDYPATKPYKALFYAALLLSEQKEIDVLVTGLPVSQFM

NPELREALKKRLEGEHQITLKRSVTVKSVVVVPQPAGAYMDIVSSTKDEGLLEVLREGK

TVVIDPGFFSVDWVALEEGEVRYHSSGTSLKAMSVLLKTINLLIQEEHGGSPGIDKIEKAI

RSGKNEILLFGQKVGLKEYLDRESFNVAQNALIQMRTSMREDGMDADVVLLAGGGAE

AYKAAAKARIQLRSATLAYAA gi|148245152|ref|YP_001219845.1|hypothetical protein CKL_4044
[*Clostridium kluyveri* DSM 555]
(SEQ ID NO: 236)
MVILGLDNGYHFTKTSEGVMFSSTVRKGKDIDINADTIQTNIDGQDYVVGAPNGEYVAD

SNKIDSIVTEICTFTAIAKSFPENKLIDCNIVAGLPVSYYSKQKSDFKEKLLGYGNKKVKL

NKHNFQINIVGAEIYPQSAGVVFVNSKDVKSDDSLVVDIGGGTVDVSAFHGLRLTNMAT

YNLGMLVLYSKLAQKLNSEYECKFMDYELYDKLKKGYITSNKFGRIDLEILNDDIEEHT

NVIILNNIKRDFNYNSMDNIFVIGGGGVELYDRIKQKFKNAILCDDAQFVNANAFELMGQ

MKFATK gi|149180011|ref|ZP_01858516.1|hypothetical protein BSG1_03310
[*Bacillus* sp. SG-1]
(SEQ ID NO: 237)
MRRDYMERSNFLAVDIGNSWYKVLASTDGVVSEYQMPNAIALFDDEFYEMPYEEEDV

EIEENLIVEVKSPSVMNKREIFYAGKSAARQRNVSLTSVNNQKVDEVRTYILLFSAAAYH

ALLTSENEMDIVYEIDQLAVSLPTTQYKEKKEQLKQRLIGSHTVILHKVPGVPEPKEVCV

KIKINDVIVGAEGACAYLGLTRDQETLGIKDDGLVKDSAKGILIGDLGGDSVDFVGIKNS

KPVASVEGEHFGINQFLDIIIQKVSKNELYKFDSRSELEEKLYAGQSEWYVEPFAGVRKD

ISKYVIPQLKSMAIKYLELFDRVRSSSNEIKGASRYIAVGGAAKLAQKQIQEAAVRWSEK

GRPINLYFPEDLEKLNVLGLMILAKMNHLKKQQEETTDLAATRG gi|241114216|ref|YP_002973691.1|hypothetical protein Rpic12D_5220
[*Ralstonia pickettii* 12D]
(SEQ ID NO: 238)
MKAATVAVDVGYGNTKFAFSMGSETKLNMFPSLAPQAAPRALANHGNGFFKARDVITI

AIDGVEYEVGPGVSLSSAYGQTGRTLSEDFVTKDEYAALLGGALRLAQVSEVGQLILGL

PVHTTQKYASYLRDRFTGTLDFGGEPVEIGSVICLPQPLGALVTFMRQQNTKFDADNAH

LVIDVGYFTTDWVAQGFTMDDNRSGGVPGGSSKIYQQIASLIEQDEGEPVTGIERIDKC

LRDKKPMLFFDKEIDLTPYLEKARSVCQLAVKEIQTRVGRTEDIRAIILAGGGSALYVPAI

RAAFPRTPIHALSSPCFANVSGFYDIGSTRPVKQK

```
gi|241589633|ref|YP_002979658.1|hypothetical protein Rpic12D_4769
[Ralstonia pickettii 12D]
                                                 (SEQ ID NO: 239)
MSKSTPAIVRAIDVGYGNTKYTLSQRNIDMDAEVGLFPSLAPRATQSDFTGGLMAKADR

IVVQVDGESYSVGMDALAESKGIYKREVASAYSTSRAYRALFLGALQKMRLTAIDYMV

VGLPLTTYDRYAKELTELLTGTHEVPNPMALDQALKVTVRRVKVFPQPSGAFYNYAVP

RKLLQSMSQQTNLVLDPGYGTLDWFVTEGAKPLTGRCSATPKSVWAVISAVADHIGPD

LTSNPRTMSRIDNALRTGAPLTINGKTIDISPFKPIVDQIVADAINDMLMSIGNLSDIDNILI

TGGGAHLFVDHVKKELGKTHSQIHVDTDPVYSNVRGFQYAGEFWAGMDRQRAAA gi|152977413|ref|YP_001376930.1|hypothetical protein Bcer98_3741
[Bacillus cereus subsp. cytotoxis NVH 391-98]
                                                 (SEQ ID NO: 240)
MSGGKMKLKTYKVEGTEYVWGDDIIKVNNTLNTYAQQNRYKTNQYKTLSKIALAEMA

AKTNVKSYDEILVITGVPSEEIGTKAVDEIKEVYQGAHDLEVNGKKVSINVVDVIVLAQP

VGTVMSRYLDEDGFVADDTYEDMTVGIIDIGTGTTDLDVISMLRREKESTSVPKGMHDV

YEPIVAKIKKETSATINDYKLEKVFEEGAYQASKRMDPIDFNDEKTASIKEVYDFIVNGV

NNAWKTFDRFDEVLVSDGGANTFHELLEEWIGKVTKLEESQTANVEGFYRYGKFEVGE

EDGE gi|153874654|ref|ZP_02002791.1|conserved hypothetical protein
[Beggiatoa sp. PS]
                                                 (SEQ ID NO: 241)
MFNLKSQRKVQLAIDIGNRLLKSCTSNGAIKTLPSWYKDLEEWDMPHSDKNSVVIHYLQ

GVNTNLVKKSWAVGNVAQDLGGNPTFESEKAFLAPKLALAMIDAGGGTQQITVERLVC

ALPNELQEEKVDAIVKGLTGTHQIKRNGEELKIEIEKVEVQPETLGAFKWVLANKSFKY

ARINGILDLGGKTGIGQLYTKNGTLIRESRIIVGGTYQLAQFVAQHPKLIRLDTTPQLSLIM

DAIADGSLSYGTMDINFADKFPIYVSQWLDDIRNKLKLSWSKWLSELGEVVIVGGSAVL

AKPIVDQTAGRFKIVKENSQFCSVLGMLQ gi|153930634|ref|YP_001393404.1|plasmid stability protein StbA family
protein [Yersinia pseudotuberculosis IP 31758]
                                                 (SEQ ID NO: 242)
MFSIPSRASYDVSIINIEGNDKSFIFETHNNKKFTVDESVPSPLDTRNIAIPYPVSDLNRVLV

HAALINAGYAGKDVHINTGLPVSHYYKPSTEINQTLVEQKKANLMHPVRCGIDGSLPVA

NIIANEVCSEGVAAYVDQLLDADGNTTEQYEEMYNSVVGVVDIGGHTTDCAVLLPKMV

INMTRSGSSEVGVLNLYDGIKTAVAAKFGINSSSITKRQIESALNTGKIMISRQAIDVSDIV

NTEKTRLFDQIIMAINEVIGTDEDIEKLIFVGGGSIVFEDYLRDHYKSIIIPEHPEFANARGM

MKLVKYIPKSN gi|156564188|ref|YP_001429698.1|mreB-like rod determination protein
[Bacillus phage 0305phi8-36]
                                                 (SEQ ID NO: 243)
MYIFGCDIGFKQFKGINLEDDIEFKFPNIIGFPTSLEIQNATDHGETMKDLWLTYDDETYY

VGDKASEFATNHRYTFLANKVDTIDETVKLLTGLGLLYETGQNKIDLMVTGVPVEEYFL

VKDKIETEFVRDYDYSFRGRKCRSTIQKVVVVPQGAGDYYDYILDESGQVITERVKPKT

VIVNIGYRTTEIVTMNNGRFSRSESTTLYTATNNFHKELRRLLAKEYGIRKNLTQIDEIYR

ERKVYIKGIATDISELITSAIDMHVGSISGEIPVWVNPDDVHEILLTGGGSTGLTPFFQSQF

GDIILKHDNPEFGNARGFAKYGRLIAHG gi|218782799|ref|YP_002434117.1|hypothetical protein Dalk_4977
[Desulfatibacillum alkenivorans AK-01]
                                                 (SEQ ID NO: 244)
MDVLGIDIGFGFTKATNGKEFLMFKSLLGEAAEIPFRANLANSSFTENLHVTVDEQTFFV

GDFAERQSGVRQSTLDQDLLVQEFAKVLALTAAGIFSEKYAPMNVVSGLPVGYFTEYK
```

```
EAFVKAILGHHTVNYHKADGSVVTRRININRVRMIPQPMGSVLNLLMDERGRITDRDLA

NKKVGVVDVGFKTTDFIIFDKLQFITRGSRTIDTGISDIFRTIANKLRKQVDVSLELYRLY

DPVSKGSIRIRGQELELAEIRDHVYAQAAGEIADEINQIWADDWDMDTVVLTGGGGME

LAKHLQPLIAGNVVGIPNDVDARLNNVQGYLKFARHLWEKDEPPPAREESAE gi|166091597|ref|YP_001654047.1|hypothetical protein pFR55_ORF058
[Bacillus thuringiensis]
                                                    (SEQ ID NO: 245)
MKIGRKVADFGNSFNNFTVDGYYFELATNVVKVSKKKAEDLLVERILNPEDLLDRLLIS

TEIDGEESYYVLGQLAEDNQLANSHVNKMHDKIKSPIPYISFLGAIAYYHALNADKEDD

EVEIDYMSMMLPIWLLKREEKFSIAHKMMEQRFIGEHKVKVLTPGMERELTITVNSAKC

RNESEIARHSLKYKMVAKDKNSNVISIEKRLEAEKFDDFEVVLTDIGGGSTDAVRLGKG

LTTPKHRDSFQVIDIEPFLGYIDRFRKEKVLQYFKDLRTLETFIVKNYKDQEYVLIDENTG

QEHDFTSEIVEALQEYAKILVAKVLDVFIPSSTNTVLKFIYIGGEAPVLEPYIRLALLEHM

NETAAKNNHFFLSDIIKHDEKEIFAPTSRTINLAALELKAIDETKEQLA gi|206974477|ref|ZP_03235393.1|conserved hypothetical protein
[Bacillus cereus H3081.97]
                                                    (SEQ ID NO: 246)
MKSLYAIDVGIGFTKRAYRQDVDSEVTIKSEASTLAPVPNHDESEDLTKVSFIDLDFAYY

MGNEAHQSDASLLPPFDEEIENYYESERFKQQIFGCIAKDYKENVVLPLVVTGLPVTCFG

SQHEQLQRALKKETSVQIDGKFITITVENALILQQPVALHAYFLKEGIIQERDRILIIDGGF

RTLEMTDMKQNVILNHYETELGCSKPLKNIKNIVQNHAGESNQLHINDMPNILEKGYGG

REEDPQTSQVHTLIQKELDAHFQDVMRVLQEQFKLDQYDTIIWTGGIVDLHKKRIEKIQG

EISSFRMVDASKEAALHGYYMIGSQVFDDITNQSVYESKL gi|218904297|ref|YP_002452131.1|hypothetical protein BCAH820_3181
[Bacillus cereus AH820]
                                                    (SEQ ID NO: 247)
MKSLYAIDVGIGFTKRAYRQDEDSEVTVKSEASTLAPVPNHDESEDLTKVSFIDLDFAYY

MGNEADQSDASFLPPFEEEIENYYESEQFKQQIFGCIAKDYKENVVLPLVVTGLPVTYFG

SQHEQLQRALKKETSVQIDGKFIHITVENALILQQPVALHAYFLKEGIIQERDRILIIDGGF

RTLEMTNMKQNVILNHYETELGCNKPLKNIKNIVQNHAGESNQLHINDMPNILEKGYGG

REENPQASQIDTLIQKELDTHFQDVMCVLQEQFMLDQYDTIIWTGGIVDLHKKRIKKMQ

GEISSFRMVDASKEAALHGYYMIGSQVFDDITNQSVYESKL gi|167630473|ref|YP_001680972.1|hypothetical protein HM1_2411
[Heliobacterium modesticaldum Ice1]
                                                    (SEQ ID NO: 248)
MNMHAARLRQLPGFEPGEGKNLTVGLDIGFGYVKVVAGNGRWALFPSIVGEGRELHIL

SGFGSNDPIDNLVVDVDGRRYFVGNLALRETEAELDIDPDKIFNIDFEVLVYTALALVSD

KSDQDVNIYLGLPINFYRTQKARFEDKLRAHQMSRFVKILGQDVRLIRIGNFEIFPQAGG

AIFNQILDFRSEVRTPRLARGKIGIIDGGTKTTDCIYMEDLKFVDQRSFSVNDGGTHKILM

DIRDFLMKNFDHYYPRLAEVDQMLRERKVEVKGKVYDLSSVIDASASRVARKIVREIAA

KWPNHMEFRAMILVGGGGYVMHPFLKEIFPDILLVQDEFEGEAVTGGWNVIQFANALG

FLKLAVMRYGEKK gi|206969331|ref|ZP_03230286.1|conserved hypothetical protein
[Bacillus cereus AH1134]
                                                    (SEQ ID NO: 249)
MKSLYAIDVGIGFTKRAYRQDVDSEVTIKSEAATLAPVPNHAESEDLTKVSFIDLDFAYY

MGNEAHQSDASFLPPFEEEIENYYESERFKQQIFGCIAKDYKENVVLPLVVTGLPVTCFG

SQHEQLQRALKKETSVQIDGKFIHITVENALILQQPIALHAYFLKEGIIQERDRILIIDGGFR
```

TLEMTDMKQNVILNHYETELGCSKPLKNIKNIVQNHEGESNQLHINDMPNILEKGYECR

EENHETSQVHTLIQKELDAHFQDVMRVLQEQFKLEQYNTIIWTGGIVDLHKKRIEKMQS

EISSFRMVDASKEAALHGYYIIGSQVFDDITNQSAYESKL gi|196032246|ref|ZP_03099660.1|conserved hypothetical protein
[*Bacillus cereus* W]
(SEQ ID NO: 250)
MKSLYAIDVGIGFTKRAYRQDEDSEVTVKSEASTLAPVPNHDESEDLTKVSFIDLDFAYY

MGNEAHQSDASFLPPFEEEIENYYESEQFKQQIFGCIAKDYKENVVLPLVVTGLPVTYFG

SQHEQLQRALKKETSVQIDGKFIHITVENALILQQPVALHAYFLKEGIIQERDRILIIDGGF

RILEMTDMKQNVILNHYETELGCNKPLKNIKNIVQNHAGESNQLHINDMPNILEKGYGG

REENPQASQIDTLIQKELDTHFQDVMCVLQEQFMLDQYDTIIWTGGIVDLHKKRIKKMQ

GEISSFRMVDASKEAALHGYYMIGSQVFDDITNQSVYESKL gi|218233147|ref|YP_002367865.1|hypothetical protein BCB4264_A3158
[*Bacillus cereus* B4264]
(SEQ ID NO: 251)
MKSLYAIDVGIGFTKRAYRQDVDSEMTVKSEASTLAPVPNHAESEDLTKVSFIDLDFAY

YMGNEAHQSDASFLPPFDEEIENYYESERFKQQIFGCIAKDYKENVVLPLVVTGLPISCF

GSQHEQLQRALKKETSVQIDGKFIHIMVENALILQQPVALHAYFLKEGIIQERDRILIIDGG

FRTLEMTDMKQNLILNHYETELGCSKPLKNIKNIVQNHEGESNQLHINDMPNILEKGYEC

REENHETSQVHTLIQKELDAHFQDVMRVLQEQFKLEQYNTIIWTGGIVDLHKKRIEKMQ

SEISSFRMVDASKEAALHGYYIIGSQVFDDITNQSAYESKL gi|218898223|ref|YP_002446634.1|hypothetical protein BCG9842_B2082
[*Bacillus cereus* G9842]
(SEQ ID NO: 252)
MKSLYAIDVGIGFTKRAYRQDVDSEMTIKSEASTLAPVPNHTDSEDLTKVSFIDLDFAYY

MGNEAHQSDASLLPPFNEEIENYYESERFKQQIFGCIAKDYKENVVLPLVVTGLPVTCFG

SQHEQLQHALKKETSVQIDGKFINITVENALILQQPVALHAYFLKEGIIQEQDRILIIDGGF

RTLEMADMKQNLILNHYETELGCSKPLKNIKNILQNHAGESNQLHINDMPKILEKGYGD

RDENYETSQVDILIQKELDAHFQDVMRVLQEQFKLDQYDTIIWTGGIVDIHKKRIEKMQ

GEIASFRMVDASKEAALHGYYIIGSQVFEDITNQSAYESKL gi|218847833|ref|YP_002454522.1|hypothetical protein BCG9842_A0080
[*Bacillus cereus* G9842]
(SEQ ID NO: 253)
MKTQLVSRKTKKNQPVLVGLDVGFGATKYISNVHPYLTALPSAVVPGKYKTSNKIVGS

KEVDLENLVVVTEEGTFTVGQLALKVPNTTTKRTVVRDRANDVFSKVLFQTGLGMAVP

HESGEYDVFLVTGLPNKDFELSIKDNLEEFLNKPFTITFPVNGGNEIKKTINVIGLEIMRQP

EGAVTYNQFTFSQEEFLVPSENAKNFIGIIDCGHFTTDYALFRDGVIMEDSITSNSTVAVN

DVYKRLRKVLTIKFDKLGYTEYQAEEEDLDNAVLTGKVEYVEAHDVSEEVGDCVKTV

AKIIAKDILDAWGNETNRVQTILLSGGGSALFSEALKQEFTERKKRGFEVLDVAQFSNVL

GYYMYGCIALTDEKEQSEVFMEFVEPVFGEEEVAETE gi|196038133|ref|ZP_03105443.1|conserved hypothetical protein
[*Bacillus cereus* NVH0597-99]
(SEQ ID NO: 254)
MKSLYAIDVGIGFTKRAYRQDEDSEVTVKSEASTLAPVPNHDESEDLTKVSFIDLDFAYY

MGNEAHQSDASFLPPFEEEIENYYESEQFKQQIFGCIAKDYKENVVLPLVVTGLPVTYFG

SQHEQLQRALKKETSVQIDGKFIHITVENALILQQPVALHAYFLKEGIIQERDRILIIDGGF

```
RTLEMTDMKQNVILNHYETELGCSKPLKNIKNILQNHAGESNQLHINDMPNILEKGYGG

REENPQASQVDTLIQKELDTHFQDVMCVLQEQFMLDQYDTIIWTGGIVDLHKKRIEKMQ

GEISSFRMVDASKEAALHGYYMIGSQVFDDITNQSVYESKL gi|196041688|ref|ZP_03108979.1|hypothetical protein BC059799_2705
[Bacillus cereus NVH0597-99]
                                                    (SEQ ID NO: 255)
MSILLKAGADAGNNGLKLMVKGQDPIFIPSIYALYIGEPTGLLDEEDVSLSELENHIDVTI

SSPSLMLNNVRYIVGEKVIQDQLKGTEVEKKSNKSTDELMVITILSGLAVSAMRQSPTSS

HISIRYDLSVALPMQLITQEIAAENAKRYMGNHKVVFHYPNGRDVTINISIEYCKCLPEG

ASGTWGIVYDEEGNVVKHKIECEQNKVSEIDFVDKTLLSFDIGAGTTEEVVSLGVNFRPQ

LSKGLSYGVKETLLQIITRWNRKYPTKTIDSITEFNQIYLNDKHPRNALLVEESQPALLGL

AARVATDIINKIDDMKDDPYVFIYGGGAVIIKNSLKMILKQKGRLTNVIFVDNPLFTNAR

GLLVYTCSPKYREHKQKELGFTNLTIS gi|206973506|ref|ZP_03234424.1|hypothetical protein BCH308197_2702
[Bacillus cereus H3081.97]
                                                    (SEQ ID NO: 256)
MSILLKAGADAGNNGLKLMVKGQDPIFIPSIYALYIGEPTGLLDEGDVSLSELENHIDVTI

SSPSLMLNNVRYIVGEKVIQDQLKGTEVEKKSNKSTDELMVITILSGLAVSAMRQSPTSS

HINIRYDLSVALPMQLITQEIAAENAKRYMGNHKVVFHYPNGRDVTINISIEYCKCLPEG

ASGTWGIVYDEEGNVVKHKIECEQNKVSEIDFVDKTLLSFDIGAGTTEEVVSLGVNFRPQ

RSKGLSYGVKETLLQIITRWNRKYPTKTIDSITEFNQIYLNDKHPRNALLVEESQPALLGL

AARVATDIINKIDDMKDDPYVFIYGGGAVIIKNSLKMILKQKGRLTNVIFVDNPLFTNAR

GLLVYTCSPKYREHKQKELGFTNLTIS gi|196048467|ref|ZP_03115642.1|conserved hypothetical protein
[Bacillus cereus 03BB108]
                                                    (SEQ ID NO: 257)
MLLGNPYAIDLGNGFTKRASKKNKSLEADVITELSVLAPVDDYYNEASFTKIELTNTDFP

YYIGEEARKSKLPLIRALGENKAKRYEDPTFKKQLFGFIAKDFKKNVTIPLLVTGLPVSHF

GNQRESIQKVAMEETAVKVNGELITIKVKQCLVIPQPVGTQYYLVKKEIINKEDRILIIDG

GFGTFDVTDMSGNAVIDRLGTELGCEKAFMSIEQIVRDNIGETPDLSVSNMHYILENGYK

YNGSLYDLYTHKDVAEQVDAELQRHFDAALREVSQKFNLAVYDKIVWTGGMAALHK

KRIEKKKEQFPTFAVLENGQEANLLGYYYLGCDVFDKLTKEKASN gi|168181408|ref|ZP_02616072.1|conserved hypothetical protein
[Clostridium botulinum Bf]
                                                    (SEQ ID NO: 258)
MKITVVDLGNINVKYVGENKGRFSSKITNDYQSYEEGFQRVEYNGIKTYIGVGELSREFN

KADRDYMAQLLYSLAKANTADTKEINLTLLLPIIQMKNKTRLIETLKGENFKFKFNGIDR

EIKINDLMVLPEGYASYYSLDIENKKGDVCILDLGSRTINICVLENAKIVKTNTIKLGSFDF

YSKIKSLENAKGEDYIEEDIQRLIDNGLIKVDSKQYIEFLSDILNAVKPYVNLKTYNTIFTG

GTSLMLKEYIEKLPLNKFKVHPNALTSNVDGAMEASKKVWNNGNK gi|168184423|ref|ZP_02619087.1|precorrin-2 methyltransferase
[Clostridium botulinum Bf]
                                                    (SEQ ID NO: 259)
MKNIIAGVDTGFGYGIGMTNDTEVIMKNYINNITEKEALNIANTIKELNNKNTLIKYNGK

YFICGDACIERYPDTMQRLNRDRIKDEYHLIELLSIVGQLTKESEFNLYLCVGLPNRSKGD

SKKFEDWLKGSAFEFSYLCNFGEVKKKVYIKDVTCLPQAYSPIFTLPRNDMNKTIFSVDI
```

-continued

GHSTLDLMLVKNMQTVMASDTLLDGEGCIRIYNNLKQALIRQNEDKKITYYSYSQLQEI

LENGNYSLYGEEQQIENILNRCLEEYAEYVFFTIENNMYKYMPTVDTFIFSGGLLNNNTF

KTILSDKFKQAYKIPLLVQNNRSQYTIAEGLKEYSNIKYADKLEVVKENDIKAAK gi|168187430|ref|ZP_02622065.1|conserved hypothetical protein
[*Clostridium botulinum* C str. Eklund]
(SEQ ID NO: 260)
MSKGNNIVDSFSVQVIDDGYADTKSRGEDTNMIVTPSYVTSWRPSYNKDNDLQEEKIDK

LSRIEVKVNGSKYLVGKCAVKQDRNIQWNGASDKHDDTSFDILLKTHLSLLTKKPISRV

KLVMGLPVTASLDKERIEKMKAKVLRQHNLGVRLYGEKEFQNKIVKVEDLIVKAQPHG

TLCDLILDSSGNLTNKDLARKVNAISDIGGKTHNLYLVDALEPLADFCDTKNSGMYIAY

MWIKNYIEQELHLNVSDGQIQYIVASGQIKGYDLTPVIQKAYRSLARKIVLEIRTVWENA

FPPFIDNIIFTGGGATILKPYLQEEFKNAMYLTRNQNASGLFKQGIRKWKRKAV gi|182419552|ref|ZP_02950800.1|hypothetical protein CBY_3706
[*Clostridium butyricum* 5521]
(SEQ ID NO: 261)
MQNYSISGIDIGHATCSTSNNVLFESKITETEPLNKASKLIIDNKELWLGEGNYDTTYRKV

DKKNYINFLYGALALSTDTVYNYIVLGLPLSQYKEDKAALTNLVLNNNEKSVIINGIQKP

LVIKDVEIYPEGVVTLDDEWEGIVVDIGGRTTDCAMVINERNRRKIINPISLPLGTINFQTD

LIKKINNKYSLDLQVNDAERILKNGLILDGEIIKDDSIEDMYNLFVDKLINQLQVEYSLRT

NFISLTGGGANLFYNSIRKQIGENSVSLQENSIYANSQAFGELGESIWQ gi|169342450|ref|ZP_02863511.1|putative plasmid partitioning protein
[*Clostridium perfringens* C str. JGS1495]
(SEQ ID NO: 262)
MILGLDIGNITSIGVGDKEDFITESRLREFEELDDFSGNDIVEINDKKFIFNEGYFENNVVK

HEKENFINLLYYTIAKTLDKENSKENDVKIVIGVPAGQYNSEKERLKKVILNNQCKNIKI

NGESRTINIEDIFIAPEGYGAKVEALQAKKEKVKLLMVDIGGGTSDAALFDENGRFIGGK

SIKVGLLDLYKNVQEVLDLKYKLSVSLEDARKYFDGELDIRNEKFEVENTYKTEALNKL

VKFLINELRGLYPNISQYAICLCGGAAGRILPVFKKVYIQAEAITDIKANAKGFRKVGLA

KWQNQGK gi|169344353|ref|ZP_02865326.1|StbA protein
[*Clostridium perfringens* C str. JGS1495]
(SEQ ID NO: 263)
MKILGLDNGYNYTKTSKNICILSTVEKGHDDYNNVLEMNFNGENYIIGEPTGQYIVDAN

KFKTEEGKELLRVTTLAAIGLSYPEESVIDVSIVAGLPVAFYADQKEELTKLIKGLDDSCI

EINKLGKKQIIKIDKVMVLPQACGIIEKNKKNESSLVIDIGGGTWDIAQFTGLKLVEKAT

YEKGMLVLYSAIAQELNAKYYTKFETSDIQNIIDRKYFTVDGVKKGIEDIEEYIDNYVRKI

AATIKRDFDTTNIDNFYLIGGGAISLESYVKKYFPSIEVEKECQFTNVNSFKFMGELKLK gi|168205970|ref|ZP_02631975.1|putative plasmid partitioning protein
[*Clostridium perfringens* E str. JGS1987]
(SEQ ID NO: 264)
MILGLDIGNITSIGVGDKEDFITESRLREFEELDDFSGNDIVEINDKKFIFNEGYFENNVVK

HEKENFINLLYYTIAKTLDKENSKENDVKIVIGVPAGQYNSEKERLKKVILNNQCKNIKI

NGESRTINIEDIFIAPEGYGAKVEALQAKKEKVKLLMVDIGGGTSDVALFDENGRFIGGK

SIKVGLLDLYKNVQEVLDLKYKLSVSLEDARKYFDGELDIRNEKFEVENTYKTEALNKL

VKFLINELRGLYPNISQYAICLCGGAAGRILPVFKKVYIQAEAITDIKANAKGFRKVGLA

KWQNQGK

-continued gi|168206394|ref|ZP_02632399.1|putative ATPase
[*Clostridium perfringens* E str. JGS1987]
(SEQ ID NO: 265)
MLKLGIDLGNGYTKFKGSKFASKTKVGRLASLAGLGEKPKDIHEVGYKGTTYIVGDGE

VFTSPDRYFGLDYEICLLTAIGLSSKEIVIDANICVGLPIIYFMSETKVLLEKKLNELTEKDS

IKITINGQDKIIKINNARVFAEGAYVLDCMDTDNIITIDLGAGTVNITQWDNLIPISYDTITK

SFNKLYRDIANHIKNTGRGVVTPAYIEANFGEDTITIDGKVVDITDTKQMISKYVSAIVSN

VYDICDVPQANKIQIFGGGAIATEEYWKNAFGKDRDGVSVLPNSQYTNSKIYQKAAEILK gi|168206979|ref|ZP_02632984.1|conserved hypothetical protein
[*Clostridium perfringens* E str. JGS1987]
(SEQ ID NO: 266)
MCIYFKVGNDNGNSEHDIIINDKLIAQPNVYSKVRKLPNLDEVNKEYVLEHIEDNLIVTC

EDPSGIYYIGNYALSSGQKIRNVEVGIDNNKLESEVIVINTLAQIAGQAVKEYYLKNKSFG

DIIKVKVDMATALPISSYSNKNAKLFSEKFTNKKHFITVHIGNEVARVEIEFEFVMVIPEG

VTSSFLFIQTDDALKKYNFKKEFFKNAKVLHVAIGEGTVEYPITKGIEFNPNFIKGSNNGV

GHAIDMALDEFKETKGLIKFSRQDYSEVLKNKKHKYNELAEDIIEQYIEEQAEEIFHNAT

KEIQKANNDIDVVCIYGGGSILMRSALEEKFKKFCDRADIKLLYFDKEDCVTLESLGLNV

LVNSKLFKTLKQNSTVKN gi|168206996|ref|ZP_02633001.1|hypothetical protein AC3_A0270
[*Clostridium perfringens* E str. JGS1987]
(SEQ ID NO: 267)
MKIIGLDIGNAEVNTSEGVHFPSRVKIGVNNMNKDDIKVNFEGLDFTIGQGSNNIGLNKY

KNINFKISVLVGIAKSFKENDIECNVVIGCPIETFNKNKEIVKDIKGIIESWGKQTIVIEQGE

SKEIKVIDIKNVAIFCESGIVFKNRERFSKEKTLVVDIGGGTRDDSLWNGLDLVECKSND

KMGMINLYETIIKEVNRRNKSNLNFDDAKAMIGKKEYKINQEIVDISYIDIIIENFVTGFM

SEINQIFPFSNVDSIQFVGGGAILLKEYITRLIPKAEVPNNAEFLNAETYREVGELMWS gi|168207292|ref|ZP_02633297.1|StbA protein
[*Clostridium perfringens* E str. JGS1987]
(SEQ ID NO: 268)
MKILGLDNGYNYTKTSMGQCILSTVEKGHDDYNNVLEMHLNGKNYIIGEPTGQYIVDA

NKFKTEEGKELVKLTTLAAIGLSYPEESVIDVSIVAGLPVAFYADQKEELTKLIKGLDDSC

IELNKIGKKQIIKINKVMILPQACGIIIEKNKKKESSLVIDIGGGTWDIAQFDGLKLVEKAT

YEKGMLVLYSAIAQELNSKYYTKFETSDIQNIIDRKFFTVEGNKKGIEDIEEYINNYVRKI

AATIKRDFDTTNIDNFYLIGGGAIALESYVKKYFPSIEVEKDCQFTNVNSFAFMGELKLK gi|168207890|ref|ZP_02633895.1|hypothetical protein AC3_A0731
[*Clostridium perfringens* E str. JGS1987]
(SEQ ID NO: 269)
MKIAIDLGNRNTKLACKTGDKIKRDIFQARFTNEEQQDYTAAEVVEIDGIKYCIEQGNYD

FEFNKTEKNYLPLLLAAISRATSDNEVEIMMGAPAEHVSGLRDKFKEQLLDKEFIFKYKD

EDRKIKINKLGVIGEGFATYFSIPEEIRNSNTNLGIIDIGGRTINVVTFINGKQHIVCTLNFGI

LDLKNNLLKELKKAGKDYDLNVVENLLLNNRIKIEEKEKEQLINRLINELKIYKIDIDLYT

WVISGGGAEDLGNEILEKYFGENSLMKDPLFTNVLGAYNFMLAKWGV gi|168211010|ref|ZP_02636635.1|putative ATPase
[*Clostridium perfringens* B str. ATCC 3626]
(SEQ ID NO: 270)
MLKLGIDLGNGYTKFKGSKFASKTKVGRLASLAGLGEKPKDIHEVGYKGTTYIVGDGE

VFTSPDRYFGLDYEICLLTAIGLSSKDIVIDANICVGLPIIYFMSKTKVLLEKKLNELTEKD

SIKITINGQDKIIKINNARVFAEGAYVLDCMDTDNIITIDLGAGTVNITQWDNLIPISYDTIT

-continued

KSFNKLYRDIANHIKNTGRGVVTPAYIEAHFGEDTITIDGKVVDITDTKQMISKYVSAIVS

NVYDICDVPQANKIQIFGGGAIATEEYWKNAFGKDRDGVSVLPNSQYTNSKIYQKAAEI

LK gi|168214610|ref|ZP_02640235.1|conserved hypothetical protein
[*Clostridium perfringens* CPE str. F4969]
(SEQ ID NO: 271)
MKVSTLGIDLGNANVKTSKSVIFESKIKPGITKMNENDIKVIYNGAEYTVGAYDGALNIS

KRKYFKTAYKINLLTAIAKSSKANNITTNIVVGVPVESFNDKNLTEEIKKHIESFENEKITV

NGVEKTINIENVEVFCESAIVFADREKFKDKKTLVIDFGGGTIDISFWDGLNLTKARTYRE

GMITLYENVIKQVNNRYSTTLNSNIAIDMIGEDKFTIDQEEKNISFINAIVETYVDGLTSYI

NQYFDVESADSIQLIGCGAIQLEKNIKDEYEKAELHPNAAFANANTYEKVGEILWI gi|168215366|ref|ZP_02640991.1|StbA protein [*Clostridium perfringens*
CPE str. F4969]
(SEQ ID NO: 272)
MKILGLDNGYNYTKTNMGQCILSTVERGHDDYNNVLEMNFNGENYIIGEPTGQYIVDA

NKFKTEEGKELVKLTTLAAIGLSYPEESVIDVSIVAGLPVAFYADQKEELTKLIKGLDDSC

IELNKIGKKQIIKINKVMVLPQACGIIIEKNKKKESSLVIDIGGGTWDIAQFDGLKLVEKAT

YEKGMLVLYSAIAQELNSKYYTKFEASDIQNIIDRKFFTVEGNKKGIEDIEEYINSYVRKI

AATIKRDFDTTNIDNFYLIGGGAIALESYVKKYFPSIEVEKNCQFTNVNSFAFMGELKLK gi|188586962|ref|YP_001918507.1|conserved hypothetical protein
[*Natranaerobius thermophilus* JW/NM-WN-LF]
(SEQ ID NO: 273)
MVWGSIPDKDRKRRRFSDGISEEDEVISEEEEHHLGGDDAFDRSVKNVGIDLGYGYVKF

IDGKEPKMFPSVVGYGNSQKYKSALQLDLNPLDDLQIKIGDEHFFIGDLAIRQSEVASRS

LGKDRSQDKNARVLMLTALSLLSSWDKQGFNLVTGLPTNFYAAFAEEWESTLNGEFKT

KMKIGGKTQERSFQIEEVTTLPQPFGTLYDQVLNSVGKVVDRDLTDSKIGIVDIGFKTTD

LAVSDGMEFINPLSFSTTTGLSNVNRLVNEKLRHEFKIDREEHQLDDCINSQKIMVAGKS

EDISSWVREALQTVSDKISVEIESKWDYRDFDTLLLTGGGGEMLYPYLKDKFPNLVLVE

DPQTANVRGYQKLANNLFNA gi|169834565|ref|YP_001693322.1|hypothetical protein CLD_A0083
[*Clostridium botulinum* B1 str. Okra]
(SEQ ID NO: 274)
MKNIIAGVDTGFGYGIGMTNDTEVKMKNYINNITEKEALNIADTIKELNDENTLIKYNGK

YFICGDACIERYPDTMQRLNRDRIKDEYHLIELLSIVGQLTKESEFNLYLCVGLPNRSKGD

SKKFEDWLKGSAFEFSYLCNFGEVKKKVYIKDVTCLPQAYSPIFTLPRNDMNKTIFSVDI

GHSTLDLMLVKNMQTVMASDTLLDGEGCIRIYNNLKQALIRQNEDKKITYYSYSQLQEI

LENGNYSLYGEEQQIENILNRCLEEYAEYVFFTIENNMYKYMPTVDTFIFSGGLLNNNTF

KTILSDKFKQAYKIPLLVQNNRSQYTIAEGLKEYSNIKYADKLEVVKENDIKVAK gi|169636508|ref|YP_001716049.1|hypothetical protein pGS18_ORF52
[*Geobacillus stearothermophilus*]
(SEQ ID NO: 275)
MKLVVANDIGNSETKMIVNDTLIKQPSVVKRLLSKPNVMETNVEKNIANLLDELIVHVT

SNAMKRSGLYFIGKRANMTADKVENMNIKLGNKSKHDIPVLMTLSMLAARSVQLAYQ

ENQELPSSISVDVSMTTAIPASEYSADQARYLEGRFTSNDHVVIVYVGETPVTVTLHFQT

VKVTQEGIPALYALLESENEILKNYNEHYKKQAVPKDFANKRILHVDIGDGTTEYIYTVG

MNPVTDVCSGEKRGVGHATEEATQLLKEEVGGFLNLRQQFMDIFRDPSHNLHDLAVR

FMQEARYSQAQRILEDIQEKYSDIAGNVDVIAVYGGGSIQFKEELYEELLDFANTVHCEV

LWIPEKYAVDMNVNGLHVINEKILFKQHA gi|169834805|ref|YP_001715854.1|hypothetical protein CLK_A0227
[*Clostridium botulinum* A3 str. Loch Maree]
(SEQ ID NO: 276)

MKNIIAGVDTGFGYGIGMTNDTEVKMKNYINNITEKEALNIADTIKELNDENTLIKYNGK

YFICGDACIERYPDTMQRLNRDRIKDEYHLIELLSIVGQLTKESEFNLYLCVGLPNRSKGD

SKKFEDWLKGSSFEFSYLCNFGEVKKKVYIKDVTCLPQAYSPIFTLPRNDMNKTIFSVDI

GHSTLDLMLVKNMQTVMASDTLLDGEGCIRIYNNLKQALIRQNEDKKITYYSYSQLQEI

LENGNYSLYGEEQQIENILNRCLEEYAEYVFFTIENNMYKYMPTVDTFIFSGGLLNNTTF

KTILSDKFKQAYKIPLLVQNNRSQYTIAEGLKEYSNIKYADKLEVVKENDIKAAK gi|169835030|ref|YP_001715925.1|hypothetical protein CLK_A0298
[*Clostridium botulinum* A3 str. Loch Maree]
(SEQ ID NO: 277)

MNKYTIAIDLGYGQIKGINQDNKRVIFPSIISSGKDRSLDTFFNSIDNIVDNIHVKILDEYFN

EKEYFVGELAKRQPSNSSFINRDNKINSEENKVLLATALGLLIPNDLPNDTKIHIVTGLPL

EHFIKQKQALNDMLKDFEHTIKFVDHNFSRNIKFEESNITLFPQGAGAIFSKINNDISSLLI

KETFIGLIDVGFKTTDIVVFRINKDKEPVFEQEMSATLDGLGMINIYNTMDKAFTDNSRD

GSKLNTEQLMLLCEEGKIFFKGDYIDLKKDLIKARKTLSTNIINKADGLWGSRKNSFNSI

MIAGGGGKVLYNHLKLIEPNMCQLIDNPEFANAIGYLEFGKQFK gi|188591469|ref|YP_001796068.1|putative plasmid stability protein,
Actin-like ATPase domain [*Cupriavidus taiwanensis*]
(SEQ ID NO: 278)

MNTTKTIAVDVGYGNTKFAFPLGADVATRMFLSLAPTRSASSLANHGDGYFQSRDVVH

VTVDGAEYEVGPDVSITSAYGNTGRTLSEDFVTTPEYAALLFGALHYSQARDVGQLILG

LPVHTLQKYAGVLQERFAGTHDFGAGSVSINRVVALPQPLGSLVTFMRQSGKDLDPDD

NCLIVDVGYFTTDWVVARGYMMDDTRSGGVPGGSSRIYQQVAQLLSADEGGEPSGSIE

RIDKSLRDGKLMRYYNKMVDLRPYFEVAKAQCQTAVKEMQTRVGRTEDIAAIVLTGG

GSALYSGAIRAAFPRSHIVAMESPCYANVRGFFDIGSARQARG gi|171320986|ref|ZP_02909976.1|conserved hypothetical protein
[*Burkholderia ambifaria* MEX-5]
(SEQ ID NO: 279)

MKTAVFAIDVGYGNTKYAHRAANNAVASGMFPSLAPLAASRSIAGYGDSVLTARKVA

TIVIDQVEYEVGPDVSLTAAYGNTGRALADDYIRTNNYAALLLGAIHFSGVTHIERLVLG

LPVHNLKKYAGALMERFTGTLDFGAGRVKIDKVMVIPQPLGSLVLASSNRKGGFGRDV

EHLVVDVGYFTTDWVYASGFAMDDKRSGGMPGGASQIYQRIAQLIARDQGDAVEDIER

IDKALREQTPFFFYGNDIDLAPYLEKAQPLISGVVKEMQNNVGRLANVRSIILSGGGAAL

YASVIRQAFPRVVIEVIDAPCLANVRGFLLVGESSVARERR gi|172055064|ref|YP_001806391.1|hypothetical protein cce_4979
[*Cyanothece* sp. ATCC 51142]
(SEQ ID NO: 280)

MVCIVKKRELKEKEKMADLTMALDFGSSLGRAIYTTSNSYIKPELLLLDPHVVEVPNIAI

ANYEKYKVGNPSPQDSSWVNLNDTYFAVGFLAKRQFSTIHCLNSLKIDSAIPLTLAMVG

AVAEIKGLGTTFSLDLGVLLPWSEFKDKDKLKSVLVSALQSFEYRGQHYHVTLQAFDAL

PEGGGLFARGRVASKGKPMKRVTETNLVVLMIGYRNASILVVERGELTIGLTSDFGFSQ

MITKIKTFTSGQSEDVLIPAICTGKSISDRTLERLARSQRAELREAEKKEIKDAIEDSQQEY

VATLTNWISQQIPPHLEIDEILLGGGTAKYFKRNLTTLLKSYGAQINWSQSLEKRVVQTF

GNEVSKNYLASRLADVYGLFYRLLKKPLPRLKEVVTRESA

-continued gi|182624909|ref|ZP_02952688.1|conserved hypothetical protein
[*Clostridium perfringens* D str. JGS1721]

(SEQ ID NO: 281)

MCIYFKVGNDNGNSEHDIIINDVLISQPNVYSKVRRLPNLDEVNKQYVIENIENNLIVTCE

DPSGIYYVGNYALSSGQKIRNVEVGIDNNKIESDVILINTLAQIAGQAVKEYYLKNKSFEE

IIKVKVDMATALPISSYSNKNAKLFSEKFTNKKHFITVHIGNEIARVEIEFEFVMVIPEGVT

SSFLFTQTDDILKKYNFKKEFFKDAKVLHVAIGEGTVEYPITKGIEFNPNFIKGSNNGVGH

AIDMALDEFKETKGLIKFSRQDYSEVLKNKKHKYNELAEDIIEQYIEEQAEEIFHNATKEI

QKANNDIDVVCVYGGGSILMRSALEEKFKKFCDRADIKLLYFDNEDCVTLESLGLNVLV

NSKLFKTLKQNSAV gi|187935818|ref|YP_001893668.1|putative ATPase
[*Clostridium botulinum* B str. Eklund 17B]

(SEQ ID NO: 282)

MNIGIDLGNGYTKFKGKKFASKVKMGRLANFGEKNKEVHEVKYNNASYVVGEGQFFIT

DDRYFTNEYKICLLTAIALASNEIVIEANICVGLPVMKYMSDVKRRLEDHLNTIGAEKIT

VNGEEKIIHIKSVTVFVESALVVKDRSQGNEITIDIGAGTENIIQWENGVPVNFDTKNKSF

YNLYNKISKYLKDVGKGDVSTEYIEKTLGQDEIIINQELVDIRDTHNIIEQHVRELASKIIS

EFDISRARRIRLMGGGGLPTYKYWKNIIEKVELADNAQFINSEIYETVLEMSGIND gi|189348522|ref|YP_001941718.1|actin-like ATPase [*Burkholderia multivorans* ATCC 17616]

(SEQ ID NO: 283)

MFPSLAPLAASRSIAGYGESVLTARKVATIVIDQVEYEVGPDVSLTAAYGNTGRALADD

YVLSANYAGLLFGAIHFAGVDHIERLVLGLPVHNMKKYSAELKERFTGELNFGAGRVTI

DKVMVIPQPLGSLVLASSNRQGGFGRDVEHLVVDVGYFTTDWVYANGFTMDDKRSGG

MPGGASQIYQRIAALIARDQGDEVEDIERIDKALREQTPFFFYGSNIDLAPYLEMAQPLIS

GVVKEMQNNVGRLANVRSIILSGGGAALYAGVIRRAFPRVVIEVIDAPCLANVRGFLLV

GESSLARERR gi|193076443|gb|AB011091.2|hypothetical protein A1S_0642
[*Acinetobacter baumannii* ATCC 17978]

(SEQ ID NO: 284)

MKGYKTLTVGVDDGHDGIKIYCGEVGKSFRLPSRVANGRTIIGDTDEVNKQIIHVNGKY

FTVDEFTKEHIDTRTEDYPLSDANVALVHHALHQAFDGQYRKFKIATGLPLNRYYGGK

DKAKNEKLIADKTQNLLINKDFNNPTVYNLYEHDKKNDPLQILNHIVLSEGQCAYFDAL

MDDNGKRSSMYEDLWEGGCAIIDIGGRTTDIAMINPRGGTMQASRCDTLDVGIITLKNK

VSQNLKEFFGLSSNITDWRLSKALKTGIYNHGGKDHDISKILNAAKVEITDQIENSIKVNV

QDGQDLGAVLLVGGGSITLGDELLKRFNYDNWHLVKQPEFANARGMYKCAKYISKL gi|197286335|ref|YP_002152207.1|plasmid-related protein
[*Proteus mirabilis* HI4320]

(SEQ ID NO: 285)

MFVLGVDIGYSNLKLAIGQSGNEPKTIILPAGAGPADRMPERIGGGDDETCLYVSVDNER

WAAGVPAGRLQGWERELHPEYPTTKTYKALFHAALLMAETESIDLVVTGLPVSQFHEP

QRKSDLVQRLKGVHQVTPKRSITVHDVKVLPQPAGAYMDLVQTGGDLGLIEEGRVVVI

DPGFFSVDWVALEAGEIRYSSSGTSLQAMSVLLETIDKLISEDHGAKVGMDRLEKAMRT

GDLQVLLFGEKVDISPYLNAAMKKVAPVALTAMRQSMRDESINADLVLIAGGGALAYK

EAAKEIFSRSKIIVPEQSVLANVRGFWFYGA gi|196250808|ref|ZP_03149494.1|conserved hypothetical protein
[*Geobacillus* sp. G11MC16]

(SEQ ID NO: 286)

MKLVVANDIGNSETKMIVNDTLIKQPSVVKRLLSKPNVTETNVEKNIANLLDELIVHVTS

NAIKRSGLYFIGKRANMTADKVENMNIKLGNKSKHDIPVLMTLSMLAARSVQLAYQEN

```
QELPPSISVDVSMTTAIPASEYSADQARYLEGRFTSNDHVVIVYVGETPVTVTLHFQTVK

VTQEGIPALYALLESENEILKNYNEHYKKQAVPKDFANKRILHVDIGDTTEYVYTVGIN

PVTDVCSGEKRGVGHATEEATQLLKEEVGGFLNLRQQFMDIFRDPSHHLHDLAVRFM

QEARYSQAQRILEDIQEKYSDIAGNVDVIAVYGGGSIQFKEELYEELLDFANTVHCEVL

WIPEKYAVDMNVNGLHVINEKILFKQHA
``` gi|197261586|ref|YP_002154401.1|hypothetical protein IEBH_gp76
[*Bacillus* phage IEBH]
(SEQ ID NO: 287)
```
MLLGNPYAIDLGNGFTKRASKKNKSLEADVITELSVLAPVDDYYNEASFTKIELTNTDFP

YYIGEEARKSKLPLIRALGENKAKRYEDPTFKKQLFGFIAKDFKKNVTIPLLVTGLPVSHF

GNQRESIRKVAMEETAVKVNGELITVKVKECLVIPQPVGTQYYLVKKEIINKEDRILIIDG

GFGTFDVTDMSGNAVIDRLGTELGCEKAFMAIEQIVRDNIGETPDLSVSNMHYILENGY

KYNGSLYDLYTHKDVAEKVDEELQRHFDAALREVSQKFNLAVYDKIVWTGGMAALH

KKRIEKKKEQFPTFAVLENGQEANLLGYYYLGCDVFDKLTKEKAAN
``` gi|208701891|ref|YP_002267154.1|hypothetical protein BCH308197_B0088
[*Bacillus cereus* H3081.97]
(SEQ ID NO: 288)
```
MSNVKEKEDFLREDEELEMLTKAYKMDSAFDVGNANVKAKINGKVLKQPSVIQYLLQ

QPPVTETNLTKLVSNLEDELTVHITSNAIKRSGLYNIGKRATITSDANVENMNIKLGNKY

KHTIPVVMTLGMMACESVKQAFSEESKLPSTINIKSKLSTAIPMSEYTVDKAKFLEDRFT

NNKHIVIVYVGGESVTVSITFEKVKVTKEGVPPLYALIEGEQAILDIYNEQYQEKAVPKD

FVNKKILHADIGDGTTEYVYTVGLNPVPDNCTGERRGVGHATESAIALLKEDTNGRVLL

KRQQYMNILKDPSHRLFDEASRFLENGKYIQAMRILEDIQEKYTEKIAGDADIICVYGGG

SIEFESLLYDDLLEFCEEVNCKLLWIPEKYAVDMNMEGLDILNKKVFFKKG
``` gi|209523842|ref|ZP_03272395.1|conserved hypothetical protein
[*Arthrospira maxima* CS-328]
(SEQ ID NO: 289)
```
MQSNKQPGQSQSQSPLAKATTTTTKPTTTTVVGRSTILSVDLGRTATKSCISRNPADVVF

VPSNVAQMSVEKARGGGFESKNTDPLLDLWLEYQGNGFAVGQLAADFGASLFGVDPA

ANPSKVNDALIKIFACVGYFNLKGDLDVVLGLPFYSQEQFEREKEQIISLLTGPNTLVFRG

EQVVVDIQSVRVMPEGYGSLIWCEAQGSKDAPNFADLSVAVVDVGHQTTDFLTVDRFR

FARGVSQSEVFAMSKFYEEVAAKIEGADAQSLFLLEAVHKPQGQRFYRPRGATKPANL

DEIVPELRKVFARDLCDRVVKWLPERVTDVVITGGGGEFFWQDLQPLLKDAQLRAHLT

QPARKANALGQYVYGEAQLAKR
``` gi|209972961|ref|YP_002300408.1|gp27.9 [*Bacillus* phage spO1]
(SEQ ID NO: 290)
```
MTHISAIDIGFLYTKAIIDGKQVKFKSVVGNGREQNFQNLDFGMNNSEDNITVKTGLDV

NFVSDLAINQSDVVLHSLEADRFSNEVTKQLVLTAFGLGFGSDHVETKIVSGLPVSHYSK

YQEEIKKLFVGDGSYKIHNFDVTSKGYQIKGSAKVVEAEFIPQPFGALLDRILDKDGDIA

DKELAKQTVAVIDPGFGTTDVYVSRSLSPIERLTFSTPTAMNFAYDLIANKIEEQTGISLA

HYKLEKAVSNKYYRVEGKQYDLTAIIQWAFRSASTQLVTEVLNRWKANSKEIDKVLIA

GGTGAAWSKWLKEKFPTAEILEDTQWAVANGYYKWGVRKFG
``` gi|222530482|ref|YP_002574364.1|hypothetical protein Athe_2523
[*Anaerocellum thermophilum* DSM 6725]
(SEQ ID NO: 291)
```
MKCAVDVGFGFTKAVNEKGKEVIFPSAVAKTFLTDIGLKPTSEYFITYMNQTYAVGKA

ATHCMITETSFSDDRFVSEFSKLLILTALMALDSDREIELGLGLPLMLYPKLKEKVRDYF
```

-continued

EFAEEIIVDSNNVAHTYHITRCEVFPQGVGALFSIDSNIEKGIYCVLDIGFRTTDVIVVEVN

ENNINPLLELCFTLDKGMSMAIEKLSIILERKYGVSYDTNLLLDIHERSQISVRGRKINIEE

QKKEVFNTIANDIVQSISRKLQRGFDTFDGVFVAGGGAFNIAAVLQKEFENVQVINNAQ

FANAKGFLNLLSILDE gi|254478361|ref|ZP_05091740.1|StbA protein [*Carboxydibrachium pacificum* DSM 12653]
(SEQ ID NO: 292)
MRRKIDAPIRRFFIFAKKFKGGGVQVFKIGLDLGYGYVKGVNEAGKTVLFPSLVGNAYQ

RNLIGLFWQNLNNLIENMHVVLRNGKEEQEEYFIGDLARREGRNVSYAFDENKINHPNT

KAVLASASALLFPSNDEPVHIVSGLPLEQYIHQKDELREMLKNFKAIVEFKGYNILKIVKF

DRVTVFPQAAGAVYYAIMDDLQKYLIKGSYIGLIDIGYRTTDYIVFVVDGKLSLREDLSG

TLDIGMSQLSNAADKLFTQRTGSKLDIPELIQLVNEGSIFYRGKILNFEKELNEVKLEISRV

IQDRIKAVWGSKLDFFNTIFLAGGGAVSLFDSLKNLYENTVLVKNSQFANAKGFLKVAE

LEEKKERDRE gi|254478265|ref|ZP_05091646.1|hypothetical protein CDSM653_706 [*Carboxydibrachium pacificum* DSM 12653]
(SEQ ID NO: 293)
MFKIGLDLGYGYVKGVNEAGKTVVFPSLIGNAYERNLKILFENGFERKIDNMHLIIMNG

QKQEYFVGELARRESRNVSYAFDEDKINHPNTKALIAASCLLLFPEDGRPVHLVTGLPLE

QYIHKKEEFKEMLKDYKTIACFKGDERVKGIKFDKITIFPQAAGAVYFAVMEDLHRYLV

KGSYLGLVDIGFKTTDFIVFLVEDRLVLREDLSGTIDLGISAVYNAADKLFTQKTGSKLD

VPELMRLTADGKIFFKGKQLNFTEELKNIKAETARVIKDRLKAVWGNKLDFFNTVFLAG

GGSKDLQEFLNDIYENTVIVKDPQLANARGFLKVAELEEKKTNTKEG gi|218289513|ref|ZP_03493741.1|hypothetical protein AaLAA1DRAFT_1327 [*Alicyclobacillus acidocaldarius* LAA1]
(SEQ ID NO: 294)
MLTIGLDVGNGSIGLCVRDGDTLVQDTMPSVYGRVDLTRRVLSVPGRSASREVDVFTFG

GEHFVLGYQNVHVMHSTPIGAYDREQRYASRQLETLAKLALLDAATRTGRTGVIEVAV

ACGTPSEDFTTRTVEIMQRWFSEPVTGAKNGEQVVVMIKRLEVIPQPFAVFLDAYLDQD

GLVVDEELEKQDVLVIDSGSGTLDLSEIHRLELTRQTSIPAGLNDVYQLILEEIRREEPKV

YATAYDLEAQLRAQDGAQEFWFEYGALRMNITELRERAMRQVWDRMQQGIQYAYPD

RSSFGRVILAGGSGEAFRNYFLAWMPSIRIAPEPQLAVARGLYKYALAQGAEES gi|218665896|ref|YP_002425759.1|hypothetical protein AFE_1323 [*Acidithiobacillus ferrooxidans* ATCC 23270]
(SEQ ID NO: 295)
MTCLGMDVGHSSVKLSWRCPDGKVVKLMIPSVVIPAMRITDKTAADTALDDTVDVAG

NTYFIGNTALHEVGNLRVSGLHDRWLDMKEFRALVQGAIDKVTRNAGKIERIVTGLPAS

TFHEQQLKMRNIVSACLDTQIRVLPEPNGIYLQHMIGLEGGVRKDRVVNAGIVAIGRYTT

DFMALLDGRWVEGVAGSCSGMSRAANLLLKQLKNEGLDVDYLDADDALWKREIRNY

GKTVDVSRDADRALSILGSEIFDSASARFGDVGRKLEKIFVGGGGADLLIGELTEYWPQA

ELVEDPRFAVAEGFRRLGESL gi|219857308|ref|YP_002474153.1|putative StbA-like protein [*Lactobacillus gasseri*]
(SEQ ID NO: 296)
MDIFSLDLGNKQTKLKSSKAEYVLPSRYLNQADMPMSVGNSTMNNDLHTYSVPFSDDK

YVWGRDIDRLHLDEYLADTIMYGARYDSEAFKLLANFALGLLASDFKAAKDQVLEVV

VTAGLPTGDYANQGQLKALLKVLEGQHQATIDDKIVTVRVRKVYILPQPIGTLYNELLD

DEGFIQNKDLLDEKVGIVDVGGGTILIDTILNFELSGKNRHQFNTGVNDLYEAIANGING

-continued

DTSLYQLEKDLRKGNQQHHWSYRFSKNRQDDITDLVCKEIDRFTRRLVANVTSTLKNL

NSIDTLFFTGGGANLLNQKILNTTFTNAVIVENTEVANVNGFYKYGLSQQAQEEGSK gi|222096627|ref|YP_002530684.1|hypothetical protein BCQ_2967
[*Bacillus cereus* Q1]
(SEQ ID NO: 297)
MKSLYAIDVGIGFTKRAYRQDVDSEVTIKSEASTLAPVPNHDESEDLTKVSFIDLDFAYY

MGNEAHQSDASLLPPFDEEIENYYESERFKQQIFGCIAKDYKENVVLPLVVTGLPVTYFG

SQHEQLQRALKKETSVQIDGKFITITVENALILQQPVALHAYFLKEGIIQERDRILIIDGGF

RTLEMTDMKQNVILNHYETELGCSKPLKNIKNIVQNHAGESNQLHINDMPNILEKGYGG

REEDTQTSQVHTLIQKELDAHFQDVMRVLQEQFKLDQYDTIIWTGGIVDLHKKRIEKMQ

GEISSFRMVDASKEAALHGYYMIGSQVFDDITNQSVYESKL gi|221316931|ref|YP_002533075.1|hypothetical protein BCQ_PT09
[*Bacillus cereus* Q1]
(SEQ ID NO: 298)
MTKVFAIDHGNGAVKMRTDVFKKTLPAIYSFSSNVGEALSGGKMKLKTYKVEGTEYV

WGDDIIKVSNTLNTYAQQNRYKTNQYKTLSKIALAEMAAKTNVKSYDEILVITGVPSQE

IGTKAVDEIKEVYQGTHEVEVNGKKVIINVVDVIVLAQPVGTVMSRYLDEDGFVADDSY

EDMTVGIIDIGTGTTDLDVISMLRREKESTSVPKGMHDVYEPIVAKIKKETSATINDYKLE

KVFEEGAYQASKRMDPIDFNDEKTASIKEVYDFIVNGVNNAWKTFDRFDEVLVSGGGA

NTFHELLEEWIGKVTKLEESQTANVEGFYRYGKFEVGEEDGE gi|224369200|ref|YP_002603364.1|hypothetical protein HRM2_21020
[*Desulfobacterium autotrophicum* HRM2]
(SEQ ID NO: 299)
MEVVGIDVGFGFTKAFNGKNSVVFKSVLGDSTQIQFRSSLGDDQDNSNLHVTLDGKSYF

IGSYAEQQSNVKEFTLDQDKLLTDFVKVLALTAIGVCCENNASLNVVSGLPVGFLTRDY

KRFADLLTGRHEIIFHYENKDDITRRIHINKIQMIPQPIGSIFNLLMDDRGKITDRKLSGQKI

GVVDIGFKTTDFSIFDHLQYIERSSTTMDTGISKCFSLIANKLRQESGVNIELYRMFSFIES

GAIKIRGREYNIANLKKRVYAHAAAAIAADVNRLWEEDWDMDSIILSGGGSMELAPFLR

SLIQGNVIPIANDVDTRLNNVQGYLKFGRHKWGYTETPVSDLPDNKETTTETNKDTALE

SDQNSGETKGRGWLKGSRT gi|242309769|ref|ZP_04808924.1|conserved hypothetical protein
[*Helicobacter pullorum* MIT 98-5489]
(SEQ ID NO: 300)
MDAQRIAIDIGYGDTKVMANGKLFKFPSAISQVGESMLQLDFKSDNPIFEGIEYRVGSKA

LMEAVATRGYLFLKRYSPLLIHNALLEAKFDLEAPIEIATGLSIVNNLEAQNFLEIISNFTI

NQIQIKPRVFLFAQGQGLYYQSGLDKEDRACVIDIGYNTLDFLVFENGKPRVDLCFANK

KGANLAITNLQKFLIKEFRVDFNEQEAKEVFVKKEIEIAGKKIDFSDVINSIMQRYVRTIT

DEVFSKAEDILSKTKNIVIGGGGAYFLKKEYLEDLHKANYLFLDNPEYSNVLGYYKSAF

KTKGV gi|239629235|ref|ZP_04672266.1|conserved hypothetical protein
[*Lactobacillus paracasei* sub sp. *paracasei* 8700:2]
(SEQ ID NO: 301)
MDIFSLDLGNKQTKLKSSKAEYVLPSRYLNQADMPMSVGNSTMNNDLHTYSVPFSDDK

YVWGRDIDGLHLDEYLADTIMYGARYDSEAFKLLANFALGLLASDFKAAKDQVLEVV

VTAGLPTGDYADQGQLKALLKVLEGQHQVTIDDKIVTVRVRKVYILPQPIGTLYNELLD

DEGFIQNKDLLDEKVGIVDVGGGTILIDTILNFELSGKNRHQFNTGVNDLYEAIANGING

DTSLYQLEKDLRKGNQQHHWSYRFSKNRQDDITDLVCKEIDRFTRRLVANVTSTLKNL

DSIDTLFFTGGGANLLNQKILNTTFTNAVIVKNTEVANVNGFYKYGLSQQAQNEGSK

-continued gi|225522260|ref|ZP_03769065.1|conserved hypothetical protein
['Nostoc azollae' 0708]
(SEQ ID NO: 302)
MTDQPPVANPMNAAAIPMNRVAPTPINNNVNKPVSVSGKNILSVDLGRTSTKTCVNREP

ANVAFIPANVKQMSIEQIRGGVFESKATDPLMDLWMEYQGNGYAVGQLAADFGANLG

VGQSKVEDALAKVLVAAGYFKLKDEISVIVGLPFLSLEQFEREKAQLMSLISGPHVMNF

RGETVSLNVTKVWVMPEGYGSLLWCETQPNKGSSMPDLTKVSVGIVDIGHQTIDLLMV

DNFRFARGASKSEDFGMSKFYEMVAKEIEGADSQSLALISAVNKPKGDRFYRPKGASKP

ANLDDFLPNLTEQFSREICSIVLAWLPERVTDVIITGGGEFFWEDVQRLLKEAKIHAHL

AAPSRQANALGQYIYGEAQLSAVRAAR gi|225174710|ref|ZP_03728708.1|hypothetical protein DealDRAFT_0563
[Dethiobacter alkaliphilus AHT 1]
(SEQ ID NO: 303)
MKESVVGIDLGFGWTKAGHNGQFFRCPSVVGEAVNLFESPTGIENNIQLWYNDQHYFV

GELAIRQATIKYFSMAANKARSDISAILAATALAALKPGRVNIVTGLPVDFYFQYKDDLD

NQLQHLPNRVRIQMDNKTYNCALEVQQTKIVPQPLGSAMSLILDSRGNTIDHRLASKNIL

VVDVGFHTLDILALSALEIIRPFSFTRPLGMAVAYKGISQDLGGLPLYDVDRLFIKNQLQ

NHTAAFQSLARQITEEIAGLNQKFDHYLITGGGGAQLYNWLLPGFERILVPDAQQANVV

GYQKLGAKTWSKRNIS gi|225685364|ref|YP_002729796.1|hypothetical protein PERMA_A0068
[Persephonella marina EX-H1]
(SEQ ID NO: 304)
MKVAFDLGFGWTKVCTDTGECFKFPTWLAYHSDTAISEVDKVLVDGKEYVVGEDARL

ERQRITITSIQELLNYFPVFKRYSLEKLGISESEAQIITGLPPIHKDKAEILEKQGAVVLPQG

LGIFLDVADKVSEEELMIIDIGFNTVDYIVVIKNKRKKGNTIEKQGVERMIELFRNKLPDS

LGYLKQFSFQRLMDVFEKGYATVEGERIDLTSYKERAIEEYNEVLKTRLKDEIGNLIDEIE

RIVIAGGGAYYLKDIRKAGIYIPEKPEFSQARGYLKYE gi|255103000|ref|ZP_05331977.1|putative ATPase of HSP70 class
[Clostridium difficile QCD-63q42]
(SEQ ID NO: 305)
MSKLGIDIGNYAVKTSTDDIFESKVTEVKNFGSDSDSIKIGNKTYYLGEGDEEINIVKYEK

ENFLPLLLGAICRNTDDEVIDLALGLPVKQFGGLRKDLIEKLQGKEYHVEFEKGNETTKR

DITIRSVQVFPEGVTGYLYYAKDIVDQIAGRDVVLVDIGGKTTDIALVQGNKATDPYSV

NVGTINIYDAIKKSLEMDERFLGKVEIKREKIQDYIDKGFYLNGEKQDIKKNIDASVGLF

KQIYNELKLNYPISTSAVVVMGGGAKLLGEAFKKNIPGIIVMSDVDKHVFANAKGYKK

MMK gi|255652545|ref|ZP_05399447.1|ATPase of HSP70 class [Clostridium
difficile QCD-37x79]
(SEQ ID NO: 306)
MKKEKVKVAVDLGNSMLNSAAYIEKELILKKLPNKLQFEKTISPKARVMKKDGKVIYL

GVGDLNNNVLKHTRKNLLEQVLVMIHEIFPDEDNLSVELITGLPPTQMFNEKYLKLFQDI

FIQPGEIKITIDGKQKTFEILNVDVKAEGYSGFISLVDKITTKQNILGIDVGGSTTDLCNYE

YDYEDDMYYPNVTDTIEKGIIDFETAIANKFNSKNGADIKISQIDVILRNDIDVIEYEGSKY

KLDDYIDAMYPIIDDMINKITNKFGQLDGYYVVGIGGGYKTFNKYANQFISKQLEVDDD

SRFYANVIGYLEQ gi|225865091|ref|YP_002750469.1|hypothetical protein BCA_3199
[Bacillus cereus 03BB102]
(SEQ ID NO: 307)
MKSLYAIDVGIGFTKRAYRQGEDSEVTVKSEASTLAPVPNHDESEDLTKVSFIDLDFAYY

MGNEAHQSNASFLPPFEEEIENYYESEQFKQQIFGCIAKDYKENVVLPLVVTGLPVTYFG

-continued

SQHEQLQRALKKETSVQIDGKFIHITVENALILQQPVALHAYFLKEGIIQERDRILIIDGGF

RTLEMTDMKQNVILNHYETELGCSKPLKNIKNIVQNHAGESDHLHINDMPNILEKGYGG

REENPQASQVDTLIQKELDTHFQDVMCVLQEQFKLDQYDTIIWTGGIVDIHKKRIEKMQ

GEISSFRMVDASKEAALHGYYMIGSQVFDDITNQSVYESKL gi|237728307|ref|ZP_04558788.1|rod shape determination protein
[*Citrobacter* sp. 30_2]
(SEQ ID NO: 308)
MSNDKLVVCGIDIGYSNVKIAVGDPADDKPTVSIYPAYATNEAVEDVRLVKRNCEHEVL

VYPGGKEWRAFTERPDARELHDRYHMTEMYLALYLASLDKIAAKSGNDIDLVVTGLPV

RLANDSERAKLTARLTGTFTIAPGKTVTVKKCLVLQQGVGVINDIVNRPGLISQEELEKA

TILVVDPGFFSMDYIAFKSGSRVSGSSGSSLKATSAIIESIVNRLNAVNPEERIDDLPEIIEIA

LRNNEPSFFNGFRHIPLRPLLEEAIPSIASDVVKELRKSTRVLGPVHIIAAAGGGTGFYEQT

IREEFPRARIVSSPLPVASNAIGFWNYGVDLMLYGDD gi|227522276|ref|ZP_03952325.1|conserved hypothetical protein
[*Lactobacillus gasseri* JV-V03]
(SEQ ID NO: 309)
MEIFSLDLGNKQTKLKSSKSEYVLPSRYLNQADMPMSVGSSTTNNDLHIYSVPFSDDKY

VWGRDIDGLHLDEYLADTIMYGDRYNSEAFKLLANFALGLLASDFKIANNQVLEVVVT

AGLPTGDYADHERLKSLLKVLEGQHQVTIDDQIVTVRVRKVYILPQPIGTLYNELLDSQG

FIKNKALLDEKVGIVDVGGGTILIDTILNFELSGKNRQQFNTGVNDLYEAIASRIEGDVSL

YQLEKELRHGNQQHQWSYRFSKNRQDDITELVGKESNRFTRRLVANVTSTLKNLDSIDT

LFFTGGGANLINQKILKTTFTNAVIVKDTEVANVNGFYKYGLSQQAQDKEGK gi|227893739|ref|ZP_04011544.1|conserved hypothetical protein
[*Lactobacillus ultunensis* DSM 16047]
(SEQ ID NO: 310)
MEIFSLDLGNKQTKLKSSKSEYVLPSRYLNQADMPMSVGSSATNNDLHTYSVPFSDDKY

VWGRGIDGLHLDEYLADTIMYGDRYNSEAFKLLANFALGLLASDFKIANNQVLEVVVT

AGLPTGDYADHERLKSLLKVLEGQHQVTIDDQIVTVRVRKVYILPQPIGTLYNELLDSQG

FIKNKALLDEKVGIVDVGGGTILIDTILNFELSGKNRQQFNTGVNDLYEAIASRIEGDVSL

YQLEKELRHGNQQHQWSYRFSKNRQDDITELVGKESDRFTRRLVANVTSTLKNLDSIDT

LFFTGGGANLINQKILKTTFTNAAIVKDTEVANVNGFYKYGLSQQAQEKEGK gi|291286593|ref|YP_003503409.1|MreB-like ATPase involved in cell
division [*Denitrovibrio acetiphilus* DSM 12809]
(SEQ ID NO: 311)
MIGIDVGYGDVKAVYVEDGELKYFKLPTAVAYAPSNSIDIIDSAEVVYSFQGREYIVGES

ARFGAFSTRSFDFLKRYSPLFIHHTLKVLKIEPTHVATGLPLGLFNRKDEMTKELITAQVD

GNTIKAEFSMFPQAVGILLDYRMDDAGKVKADTAKNGIVLDIGFNTIDVLCFEKGTAIRS

DAKTLDKFGISKIVLELVELINREHGIQLSDQEAKDVFLAGQMNVYGSRIDLTEAIRNITE

MYFDEVMHNIRSLWDKRLQRADLLLLAGGGAVTIAKYVPSEYAKIVKVPERSEFANAR

GYFKALMAKQEQALKAD gi|291286482|ref|YP_003503298.1|MreB-like ATPase involved in cell
division [*Denitrovibrio acetiphilus* DSM 12809]
(SEQ ID NO: 312)
MIGIDVGYGDVKAVYMDVGELKYFKLPTAVAYAPMNSIDIADEAEERYSFQGREYIVG

ESARFGAFSTRSFDFLKKYAPLFIHHTLKVLRLVPSYVATGLPLGLFNRKDEMTKELTTA

QVDGNTIKAEFSMFPQAVGILLDYRMDDAGKVKADTAKNGIVSDIGFNTIDVLCFEKGT

```
AIRSDAKTLDKFGISKIVLELVELINREHGIQLSDQEAKDVFLAGRMNVYGNKIDLTEAIR

NITEMYFDEVMHNIRSLWDKRLQRADLLLLAGGGAVTIAKYVPSEYAKIVKVPERSEFA

NARGYLKALMAKQEQALKADK gi|227892254|ref|ZP_04010059.1|conserved hypothetical protein
[Lactobacillus salivarius ATCC 11741]
                                                (SEQ ID NO: 313)
MSKNNVVKMNVANDLGYGSVKAKVNDTKIHFPSVLALQREQDIAKPVEFDSEKEKLSY

LSDMINHMDITVSSSAVKTQGRFLLGTAAVKSSLPMRAFDVNDFTGKSDNDLSIILTLG

MIAAQRVALAVENGEDLSEQLNAEVNMTTALPVSEGKKNGIVDSYINKYVNSKHTVVF

HNLKDPITVSLTFNKVYVALEGEVAQLYIQNSDIKLKGLIKKDFAKNYPELATEIEVTDL

VKIKNLLGIDIGEGTTDLVVIKDGKANAVSSTSLPTGYGNALQDAIDVLQTQNMNFEAR

SQLQDYLSQDVSPLAKRMQNKVRQTVFEQLAPFADKIVEAASKTMRKAGANVEVLYV

YGGGSIPMLEQTELRQKLAQKMKDFSGGIDVPVIWIDKSYAQILNEKGLELVLNVLK gi|227892068|ref|ZP_04009873.1|conserved hypothetical protein
[Lactobacillus salivarius ATCC 11741]
                                                (SEQ ID NO: 314)
MEIFSLDLGNKQTKLKSSKNEYVLPSQILNGEDMPQQLSDFGKKRDINYFKVPFDDSEWI

WGKDLSTLKRDDYLQDTLMHQNRYSNDTFKLLANFALGLLATDFEKAVENILEVTVVT

GLPTDDYNSQKQLKDLSSILKGQHQIEVDGVTYTVRVKHVLIIPQPVGTFYDVLLDDEG

VLVNDELLEEKVGIVDAGGGTILIDTLLNFELDKRNRRQYATGANDLYEAIMSQMDGN

VSLYQIEKMVRNGIKERKFSYRYSKNHIEDVTDLVEKEITNFTRRLVSNLKSTFKDIDSID

TLIITGGSANLINQRLIVDFFETAYFVKDSELANVRGFYKYALTAE gi|258510592|ref|YP_003184026.1|hypothetical protein Aaci_0589
[Alicyclobacillus acidocaldarius subsp. acidocaldarius DSM 446]
                                                (SEQ ID NO: 315)
MIVGLDVGFGHLKWTTDGHTVHRMPAVAAPTWTEPDVVSGDHAWVVGEHAEREDAT

LAVALDHERLSRPEFQALLGYVFATLPDEPLQVVSGLPYSATEEEQANYERQLREIVGPY

QVGERVWKGPVPSVTLFRQAQAALIDALFDERNRPRRPELLQEGLRIALIDVGYKTTDV

VVAVLFPAYQIVREMSLSLDVGVHNVEAMLQRAYQRAYGAEMLDRERMRLALDGKRI

YRFGQPVTLPVDEARRQVAERIRAGVVQHWGRAISTVARVFLAGGGAALLGAYLAQPP

LVAEMVPDPQGANARGFYKLGRFAETA gi|257793030|ref|YP_003186429.1|hypothetical protein Aaci_3037
[Alicyclobacillus acidocaldarius subsp. acidocaldarius DSM 446]
                                                (SEQ ID NO: 316)
MLTIGLDVGNGSIGLCVRDGDTLVQDTTPSVYGRVDPTRQVLSVPGKSAPRKVDVFTFG

GEHFVLGYKNVHAMHSTPIGAYDREQRYASRQFETLAKLALLDAATRTGRTGVIEVVV

ACGTPSEDFTTRTVEIMQRWFSEPVTGAKNGEQVVVMIKRLEVIPQPFGVFLDAYLDQD

GLVVDEELEKQDVLVIDSGSGTLDLSEIHRLELTRQTSIPAGLNDVYQLILEEIRREEPKV

YATAYDLEAQLRAQDGAQEFWFEYGALRMNITNLRERAMRQVWDRMQQGIQYAYPD

RSSFGRVILAGGSGEAFRNYFLAWMPSIRIAPEPQLAVARGLYKYALAQGAEES gi|258511177|ref|YP_003184611.1|hypothetical protein Aaci_1191
[Alicyclobacillus acidocaldarius subsp. acidocaldarius DSM 446]
                                                (SEQ ID NO: 317)
MVIGVDLGYGWVKATNGERSNRFPALVGEAHELLLSDLFGVPEYDVHIETPFGSRRVFV

GELARQESQAAWNLATKKFEDTDTEALWLTALALFARDGEPLDVVTGLPLAHYEAQR

AALRERLLSLRGRVTIQGRIVEVEARSVRVIPQAMGAMIASLLDPATLELRNPAWTEHG
```

-continued

GYLLLVDVGTRTTGFVTFETQPELRLMNRLSDSVDVGVHDLYVALASVFRQRTGETPPL

SDGLYDELYARGEVFYGGHTVSVEPERSRHIERMGGLIVRRIQEHLGAEALKRVHTVFV

AGGGYRIVQTTLQRMFPRVVVVPNPQMANAEGYRLYGLTRAGSGR gi|229199704|ref|ZP_04326345.1|hypothetical protein bcere0001_51830
[*Bacillus cereus* m1293]
(SEQ ID NO: 318)
MKSLYAIDVGIGFTKRAYRQDVDSEVTIKSEASTLAPVPNHDESEDLTKVSFIDLDFAYY

MGNEAHQSDASLLPPFDEEIENYYESERFKQQIFGCIAKDYKENVVLPLVVTGLPVTYFG

SQHEQLQRALKKETSVQIDGKFITITVENALILQQPVALHAYFLKEGIIQEQDRILIIDGGF

RTLEMTDMKQNVILNHYETELGCSKPLKNIKNIVQNHAGESNQLHINDMPNILEKGYGG

REEDPQTSQVHTLIQKELDAHFQDVMRVLQEQFKLDQYDTIIWTGGIVDLHKKRIEKIQG

EISSFRMVDASKEAALHGYYMIGSQVFDDITNQSVYESKL gi|229191241|ref|ZP_04318229.1|hypothetical protein bcere0002_29060
[*Bacillus cereus* ATCC 10876]
(SEQ ID NO: 319)
MKSLYAIDVGIGFTKRAYRQDVDSEVTIKSEAATLAPVPNHAESEDLTKVSFIDLDFAYY

MGNEAHQSDASFLPPFEEEIENYYESEEFKQQIFGCIAKDYKENVVLPLVVTGLPVTCFG

SQHEQLQCALKKETSVQIDGKFINITVENALILQQPIALHAYFLKEGIIQEQDRILIIDGGFR

TLEMTDMKQNLILNHYETELGCSKPLKNIKNILQNHAGESNQLHINDMPKILEKGYGDK

EENYETSQVDILIQKELDTHFQDIMRVLQEQFKLDQYDTIIWTGGIVDLHKKQIEKMQGE

IVSFRMVDASKEAALHGYYIIGSQVFEDITNQSAYKSKL gi|229187864|ref|ZP_04314983.1|hypothetical protein bcere0004_53870
[*Bacillus cereus* BGSC 6E1]
(SEQ ID NO: 320)
MLLGNPYAIDLGNGFTKRASKKNKSLEADVITELSVLAPVDDYYNEASFTKIELTNTDFP

YYIGEEARKSKLPLIRALGENKAKRYEDPTFKKQLFGFIAKDFKKNVTIPLLVTGLPVSHF

GNQRESIRKVAMEETAVKVNGELITVKVKECLVIPQPVGTQYYLVKKEIINKEDRILIIDG

GFGTFDVTDMSGNAVIDRLGTELGCEKAFMAIEQIVRDNIGETPDLSVSNMHYILENGY

KYNGSLYDLYTHKDVAEKVDEELQRHFDAALREVSQKFNLAVYDKIVWTGGMAALH

KKRIEKKKEQFPTFAVLENGQEANLLGYYYLGCDVFDKLTKEKASN gi|229179428|ref|ZP_04306781.1|hypothetical protein bcere0005_27770
[*Bacillus cereus* 172560W]
(SEQ ID NO: 321)
MKSLYAIDVGIGFTKRAYRQDVDSEVTIKSEAATLAPVPNHAESEDLTKVSFIDLDFAYY

MGNEAHQSDASFLPPFDEEIENYYESEEFKQQIFGCIAKDYKENVVLPLVVTGLPVTCFG

SQHEQLQRALKKETSVQIDGKFINITVENALILQQPIALHAYFLKEGIIQEQDRILIIDGGFR

TLEMTDMKQNVILNHYETELGCSKPLKNIKNILQNHAGESNQLHINDMPKILEKGYGDK

EENYETSQVDILIQKELDTHFQDIMRVLQEQFKLDQYDTIIWTGGIVDLHKKQIEKMQGE

IVSFRMVDASKEAALHGYYIIGSQVFEDITNQSAYKSKL gi|229173780|ref|ZP_04301321.1|hypothetical protein bcere0006_28790
[*Bacillus cereus* MM3]
(SEQ ID NO: 322)
MKSLYAIDVGIGFTKRAYRQDVDSEVTIKSEASTLAPVPNHAESEDLTKVSFIDLEFAYY

MGNEAHQSDASFLPPFDEEIESYYESEQFKQQIFGCIAKDYKENVVLPLVVTGLPVTYFG

SQHEQLQNVLKKETSVQIDGKFINITVENVLILQQPVALHAYFLKEGIIQEQDRILTIDGGF

RTLEITDMKQNVILNHYETELGCSKPLKNIKNILQNHAGESDDLHINDMPKILEKGYGGR

EENHQTSQVDTLIQKELDTHFQDVMRVLQEQFKLDQYDTIIWTGGIVDIHKKRIEKMQG

EISSFRMVDASKEAALHGYYIIGSQVFEDITNQSAYESKL gi|229173396|ref|ZP_04300940.1|hypothetical protein bcere0006_24970
[*Bacillus cereus* MM3]

(SEQ ID NO: 323)

MSILLKAGADAGNNGLKLMVKGQDPIFIPSIYSLYIGEPTGLLDESDVSLSELENHIDVTIS

SPSLMLNNVRYIVGEKVIQDQLKGTEVEKKSNKSTDELMVITILSGLAVSAMRQSPTSGH

INIRYDLSVALPMQLITQEIAAENAKRYMGNHKVVFHYPNGRDVTINISIEYCKCLPEGA

SGTWGIVYDEEGNVVKHKIECEQNQVSEIDFVDKTLLSFDIGAGTTEEVVSLGVNFRPQL

SKGLSYGVKETLLQIITRWNRKYPTKTIDSITEFNQIYLHEKHPRNALLVEESQPALLGLA

ARVATDIINKIDDMKDDPYVFIYGGGAVIIKNSLKMILKQKGRLTNVIFVDNPLFTNARG

LLVYTCSPKYREHKQKELGFTNLTIS gi|229168012|ref|ZP_04295742.1|hypothetical protein bcere0007_29710
[*Bacillus cereus* AH621]

(SEQ ID NO: 324)

MKINMMNKDSGNSLDMNLIDGFYIETPTNVVEISKDEADSHFVATITNPKELLSRLLISTT

IPGEDTERFFLVGDEAAKHALANNHVNKLHDKITSPIPYVMFLSAISFYHAINEQRESDD

NTIEIEYFQTMLPIWLLKRTAKFSEAQNAMAERFAGEHEVTIHTPGMEKTLKITVEKATC

RIEGEIARLAIKKNFELEDREEASQFDNNDTVLVDIGGGTIDLVLSPVGLKSPKNRDSMQP

IDKLSYLSHIEKLRKEKFLEKFSDLRSFETFIVNNFQKPKMELVDGNTGQRVDLTDKVRS

SLKEFAKFLILKIQDVMPAPADKVYKYVYFGGVAPILEASIHEVIEEMYGAEIAQANHIFL

PDSRKLNLYGLEVKSRGEMLQKTEK gi|229161622|ref|ZP_04289602.1|hypothetical protein bcere0009_24080
[*Bacillus cereus* R309803]

(SEQ ID NO: 325)

MSILLKAGADAGNNGLKLMVKGQDPVFIPSIYSLYIGEPTGLLDEGDVSLSELENHIDVTI

SSPSLMLNNVRYIVGEKVIQDQLKGTEVEKKSNKSTDELMVITILSGLAVSAMRQSPTSS

HINIRYDLSVALPMQLITQEIAAENAKRYMGNHKVVFHYPNGRDVTINISIEYCKCLPEG

ASGTWGIVYDEEGNVVKHKIECEQNQVSEIDFVDKTLLSFDIGAGTTEEVVSLGVNFRPQ

LSKGLSYGVKETLLQIITRWNRKYPTKTIDSITEFNQIYLNEKHPRNALLVEESQPALLGL

AARVATDIINKIDDMKDDPYVFIYGGGAVIIKNSLKMILKQKGRLTNVIFVDNPLFTNAR

GLLVYTCSPKYREHKQKELGFTNLTIS gi|229156745|ref|ZP_04284832.1|hypothetical protein bcere0010_29300
[*Bacillus cereus* ATCC 4342]

(SEQ ID NO: 326)

MKSLYAIDVGIGFTKRAYRQDVDSEVTIKSEASTLAPIPNHAESEDLTKVSFIDLDFAYY

MGNEAHQSDASFLPPFDEEIENYYESEQFKQQIFGCIAKDYKENVVLPLVVTGLPVTCFG

SQHEQLQRALKKETSVQIDGKFITITVENVLILQQPVALHAYFLKEGIIQEQDRILIIDGGF

RTLEMTDMKQNVILNHYETELGCSKPLKNIKNILQNHAGESGHLHINDMPKILEKGYGG

REENHQTSQVDTLIQKELDTHFQDVMRVLQEQFKLDQYDTIIWTGGIVDIHKKRIEKIQG

EISSFRMVDASKEAALHGYYMIGSQVFDDITNQSVYESKL gi|229156322|ref|ZP_04284418.1|hypothetical protein bcere0010_25110
[*Bacillus cereus* ATCC 4342]

(SEQ ID NO: 327)

MSILLKAGADAGNNGLKLMVKGQEPVFIPSIYALYIGEPTGLLDEVDVSLSELENHIDVTI

SSPSLMLNNVRYIVGEKVIQDQLKGTEVEKKSNKSTDELMVITILSGLAVSAMRQSPTSS

HINIRYDLSVALPMQLITQEIAAENAKRYMGNHKVVFHYPNGRDVTINISIEYCKCLPEG

ASGTWGIVYDEEGNVVKHKIECEQNKVSEIDFVDKTLLSFDIGAGTTEEVVSLGVNFRPQ

-continued

LSKGLSYGVKETLLQIITRWNRKYPTKTIDSITEFNQIYLNDKHPRNALLVEESQPALLGL

AARVATDIINKIDDMKDDPYVFIYGGGAVIIKNSLKMILKQKGRLTNVIFVDNPLFTNAR

GLLVYTCSPKYREHKQKELGFTNLTIS gi|229151340|ref|ZP_04279544.1|hypothetical protein bcere0011_28860
[*Bacillus cereus* m1550]
(SEQ ID NO: 328)
MKSLYAIDVGIGFTKRAYRQDVDSEVTIKSEAATLAPVPNHAESEDLTKVSFIDLDFAYY

MGNEAHQSDASFLPPFEEEIENYYESEEFKQQIFGCIAKDYKENVVLPLVVTGLPVTCFG

SQHEQLQHALKKETSVQIDGKFINITVENALILQQPVALHAYFLKEGIIQERDRILIIDGGF

RTLEMTDMKQNLILNHYETELGCSKPLKNIKNILQNHAGESNQLHINDMPKILEKGYGD

KEENYETSQVDILIQKELDTHFQDIMRVLQEQFKLDQYDTIIWTGGIVDLHKKQIEKMQG

EIVSFRMVDASKEAALHGYYIIGSQVFEDITNQSAYESKL gi|229148199|ref|ZP_04276502.1|hypothetical protein bcere0012_52920
[*Bacillus cereus* BDRD-ST24]
(SEQ ID NO: 329)
MLLGNPYAIDLGNGFTKRASKKNKSLEADVITELSVLAPVDDYYNEASFTKIELTNTDFP

YYIGEEARKSKLPLIRALGENKAKRYEDPTFKKQLFGFIAKDFKKNITIPLLVTGLPVSHF

GNQRESIRKVAMEETAVKVNGELITVKVKECLVIPQPVGTQYYLVKKEIINKEDRILIIDG

GFGTFDVTDMSGNAVIDRLGTELGCEKAFMAIEQIVRDNIGETPDLSVSNMHYILENGY

KYNGSLYDLYTHKDVAEKVDEELQRHFDSSLREVSQKFNLAVYDKIVWTGGMAALHK

KRIEKKKEQFPTFAVLENGQEANLLGYYYLGCDVFDKLTKEKASN gi|229141745|ref|ZP_04270274.1|hypothetical protein bcere0013_48340
[*Bacillus cereus* BDRD-ST26]
(SEQ ID NO: 330)
MMNKDSGNSLDMNLIDGFYIETPTNVVEISKDEADSHFVATITNPKELLSRLLISTTIPGE

DTERFFLVGDEAGKHALANNHVNKLHDKITSPIPYVMFLSAVSFYHAINETRESDDNTV

EIEYFQTMLPIWLLKRTAKFSEAQNAMAERFAGEHEVTIHTPGMEKTLKITVEKATCRIE

GEIARLAIKKNFELEDREEARQFDNNDTVLVDIGGGTIDLVLSPAGLKSPKNRDSMQPID

KLSYLSHIEKLRKEKFLEKFSDLRSFETFIVNNFQKPKMELVDGNTGQRVDLTEKIRSSLK

EFAKFLILKIQDVMPAPADKVYKYVYFGGVAPILETSIHEVIEEMYGAEIAQANHIFLPDS

RKLNLYGLEVKSRGEMLQKTEK gi|229125147|ref|ZP_04254297.1|hypothetical protein bcere0016_54110
[*Bacillus cereus* 95/8201]
(SEQ ID NO: 331)
MFLTASVDAGNDALKAYIGGLEEENKVYIPNVVKKMEDRPILSLGDDPLAELHLRITSSA

INISGTYAVGTLAVKEKDSSHIPATVMKSDSDQTVILALTALAYYAAMNSKAKKVDVEY

LLSSGLPVDEVKADRRASFKEKLVEGTHVIEFKKTPLLEGKTVNIKFRDAFMNVEGFAA

MVNLTVDDKLQAINNDLKQKNILLNDMGGNTTDKAVIRMGRIDNEYSSGSPLGIGEYL

DAIKKEVFTTFRVDVFKSRRQLVENMTAEKEAYVIRPHGKAESYQAIAEKHLMEFAMR

EYADLVEKWKEVGDLHCIYNVGGSAAIAKPFLEQINKENNQFEMYFLDTEESIWSIAKA

YYKLLLIIAKQKGLDLKK gi|228928208|ref|ZP_04091249.1|hypothetical protein bthur0010_29070
[*Bacillus thuringiensis* serovar *pondicheriensis* BGSC 4BA1]
(SEQ ID NO: 332)
MKSLYAIDVGIGFTKRAYRQDEDSEVTVKSEASTLAPVPNHDESEDLTKVSFIDLDFAYY

MGNEAHQSDASFLPPFEEEIENYYESEQFKQQIFGCIAKDYKENVVLPLVVTGLPVTYFG

SQHEQLQRALKKETSVQIDGKFIHITVENALILQQPVALHAYFLKEGIIQERDRILIIDGGF

RTLEMTDMKQNVILNHYETELGCNKPLKNIKNIVQNHAGESNQLHINDMPNILEKGYGG

-continued

REENPQASQIDTLIQKELDTHFQDVMCVLQEQFMLDQYDTIIWTGGIVDLHKKRIKKMQ

GEISSFRMVDASKEAALHGYYMIGSQVFDDITNQSVYESKL gi|229116639|ref|ZP_04246025.1|hypothetical protein bcere0017_29240
[*Bacillus cereus* Rock1-3]
(SEQ ID NO: 333)
MRSLYAIDVGIGFTKRAYRQDVDSEVTIKSEASTLAPVPNHAESEDLTKVSFIDLDFAYY

MGNEAHQSDASFLPPFDEEIENYYESERFKQQIFGCIAKDYKENVVLPLVVTGLPVTCFG

SQHEQLQRALKKETSVQIDGKFINITVENALILQQPVALHAYFLKEGIIQERDRILIIDGGF

RTLEMTDMKQNVILNHYETELGCSKPLKNIKNIMQNHGGESNHLHINDMPKILEKRYEC

REENPQTKQVHTLIQKELDAHFQDVMRVLQEQFKLEQYDTIIWTGGIVDLHKKRIEKMQ

GEISSFRMVDASKEAALHGYYIIGSQVFEDITNQSAYESKL gi|229110589|ref|ZP_04240155.1|hypothetical protein bcere0018_28400
[*Bacillus cereus* Rock1-15]
(SEQ ID NO: 334)
MKSLYAIDVGIGFTKRAYRQDVDSEMTIKSEASTLAPVPNHAESEDLTKVSFIDLDFAYY

MGNEAHQSDASFLPPFDEEIENYYESERFKQQIFGCIAKDYKENVVLPLVVTGLPVTCFG

SQHEQLQRALKKETSVQIDGKFIHIKVENALILQQPVALHAYFLKEGIIQERDRILIIDGGF

RTVEMTDMKQNVILNHYEAELGCSKPLKNIKNIVQNHEGESNQLHINDMPNILEKGYEC

REENHETSQVHTLIQKELDAHFQDVMRVLQEQFKLEQYNTIIWTGGIVDLHKKRIEKMQ

SEISSFRMVDASKEAALHGYYIIGSQVFEDITNQSAYESKL gi|229100588|ref|ZP_04231438.1|hypothetical protein bcere0020_57600
[*Bacillus cereus* Rock3-29]
(SEQ ID NO: 335)
MKITMMNKDSGNSLDMNLIDGFYIETPTNVVEISKDEADSHFVATITNPKELLSRLLISTK

IPGEDTERFFLVGDEAAKHALANNHVNKLHDKITSPIPYVMFLSAVSFYHAINEQRESDD

NTIEIEYFQTMLPIWLLKRTAKFSEAQNAMAERFAGEHEVTIHTPGMEKTLKITVEKATC

RIEGEIARLAIKKNFELEDREEARQFDNNDTVLVDIGGGTIDLVLSPTGLKSPKNRDSMQP

IDKLSYLSHIEKLRKEKFLEKFSDLRSFETFIVNNFQKPKMELVDGNTGQRVDLTDKVRS

SLKEFAKFLILKIQDVMPAPADKVYKYVYFGGVAPILETSIHEVIEEMYGAEIAQANHIFL

PDSRKLNLYGLEVKSRGEMLQKIER gi|229097636|ref|ZP_04228594.1|hypothetical protein bcere0020_28770
[*Bacillus cereus* Rock3-29]
(SEQ ID NO: 336)
MRSLYAIDVGIGFTKRAYRQDVDSEVTIKSEASTLAPVPNHAESEDLTKVSFIDLDFAYY

MGNEAHQSDASFLPPFDEEIENYYESERFKQQIFGCIAKDYKENVVLPLVVTGLPVTCFG

SQHEQLQRALKKETSVQIDGKFINITVENALILQQPVALHAYFLKEGIIQERDRILIIDGGF

RTLEMTDMKQNVILNHYETELGCSKPLKNIKNIMQNHGGESNHLYINDMPKILEKRYEC

REENPQTKQVHTLIQKELDAHFQDVIRVLQEQFKLEQYDTIIWTGGIVDLHKKRIEKMQ

GEISSFRMVDASKEAALHGYYIIGSQVFEDITNQSAYESKL gi|229092129|ref|ZP_04223310.1|hypothetical protein bcere0021_29190
[*Bacillus cereus* Rock3-42]
(SEQ ID NO: 337)
MKSLYAIDVGIGFTKRAYRQDKDSEVTIKSEASTLAPVPNHDESEDLTKVSFIDLDFAYY

MGNEAHQSDASFLPPFEEEIENYYESEQFKQQIFGCIAKDYKENVVLPLVVTGLPVTYFG

SQHEQLQRALKKETSVQIDGKFIHITVENALILQQPVALHAYFLKEGIIQERDRILIIDGGF

RTLEMTDMKQNVILNHYETELGCSKPLKNIKNILQNHAGESNQLHINDMPNILEKGYGG

REENPQASQVHTLIQKELDTHFQDVMCVLQEQFMLDQYDTIIWTGGIVDLHKKRIEKMQ

GEISSFRMVDASKEAALHGYYMIGSQVFDDITNQSVYESKL gi|229082948|ref|ZP_04215369.1|hypothetical protein bcere0023_55370
[*Bacillus cereus* Rock4-2]
(SEQ ID NO: 338)
MNLIDGFYIETPTNVVEISKDEADSHFVATITNPKELLSRLLISTTIPGEDTERFFLVGDEA

GKHALANNHVNKLHDKITSPIPYVMFLSAISFYHAINETRESDDNTIEIEYFQTMLPIWLL

KRTAKFSEAQNAMAERFAGEHEVTIHTPGMEKTLKITVERATCRIEGEIARLAIKKNFEL

EDREEARQFDNNDTVLVDIGGGTIDLVLSPAGLKSPKNRDSMQPIDKLSYLSHIEKLRKE

KFLEKFSDLRSFETFIVNNFQKPKMELIDGNTGQRVDLTDKIRSSLKEFAKFLILKIQDVM

PAPADKVYKYVYFGGVAPILETSIHEVIEEMYGAEIAQANHIFLPDSRKLNLYGLEVKSR

GEMLQKTEK gi|229080324|ref|ZP_04212849.1|hypothetical protein bcere0023_29710
[*Bacillus cereus* Rock4-2]
(SEQ ID NO: 339)
MKSLYAIDVGIGFTKRAYRQDVDSEVTIKSEAATLAPVPNHAESEDLTKVSFIDLDFAYY

MGNEAHQSDASFLPPFDEEIENYYESEEFKQQIFGCIAKDYKENVVLPLVVTGLPVTCFG

SQHEQLQRALKKETSVQIDGKFINITVENALILQQPIALHAYFLKEGIIQEQDRILIIDGGFR

TLEMTDMKQNVILNHHETELGCSKPLKNIKNILQNHAGESNQLHINDMPKILEKGYGDK

EENYETSQVDILIQKELDTHFQDIMRVLQEQFKLDQYDTIIWTGGIVDLHKKQIEKMQGE

IVSFRMVDASKEAALHGYYIIGSQVFEDITNQSAYKSKL gi|229075142|ref|ZP_04208136.1|hypothetical protein bcere0024_28830
[*Bacillus cereus* Rock4-18]
(SEQ ID NO: 340)
MKSLYAIDVGIGFTKRAYRQDVDSEVTIKSEASTLAPVPNHAESEDLTKVSFIDLDFAYY

MGNEAHQSDASFLPPFDEEIENYYESERFKQQIFGCIAKDYKENVVLPLVVTGLPVTCFG

SQHEQLQRALKKETSVQIDGKFINITVENVLILQQPVALHAYFLKEGIIQERDRILIIDGGF

RTLEMTDMKQNLILNHYETELGCSKPLKNIKNIMQNHAGESNHLHINDMPKILEKGYGG

REENPQTKQVDTLMQKELDVHFQDVMRVSQEQFKLEQYDTIIWTGGIVDLHKKRIEKM

QGEISSFRMVDASKEAALHGYYIIGSQVFEDITNQSAYESKL gi|229070642|ref|ZP_04203879.1|hypothetical protein bcere0025_28240
[*Bacillus cereus* F65185]
(SEQ ID NO: 341)
MKSLYAIDVGIGFTKRAYRQDVDSEVTIKSEAATLAPVPNHAESEDLTKVSFIDLDFAYY

MGNEAHQSDASFLPPFDEEIENYYESEEFKQQIFGCIAKDYKENVVLPLVVTGLPVTCFG

SQHEQLQRALKKETSVQIDGKFINITVENALILQQPIALHAYFLKEGIIQEQDRILIIDGGFR

TLEMTDMKQNVILNHYETELGCSKPLKNIKNILQNHEGESNQLHINDMPKILEKGYGDK

EENYETSQVDILIQKELDTHFQDIMRVLQEQFKLDQYDTIIWTGGIVDLHKKQIEKMQGE

IVSFRMVDASKEAALHGYYIIGSQVFEDITNQSAYKSKL gi|229051382|ref|ZP_04194887.1|hypothetical protein bcere0027_53100
[*Bacillus cereus* AH676]
(SEQ ID NO: 342)
MLLGNPYAIDLGNGFTKRASKKNKELEAAVITELSVLAEVDDYYNEASFTKIELTNIDSP

YYIGEEARKSKLPLVRALGENKAKRYEDPIFKKLLFGFIAKDFKKSKHISLPLLVTGLPVS

HFGNQRETLEKVITTETSMKVNGEMITVDVKKCLVIPQPVGTQYYLVKKNIIEKDDRILII

DGGFGTLDVTDMSGNSVIGRLGTELGCEKAFLNIEQIVRDNIGETPELSVSNMHYILENS

YKYNGNSHNLYKDDKVSEKVESELKHHFASVLREVSQKFNFAVYDKIIWTGGMASLHK

ALIIEQQTKFPTFELLENGQEANLLGYYYLGDDVFDKITKEKAAN

```
gi|229046843|ref|ZP_04192477.1|hypothetical protein bcere0027_28580
[Bacillus cereus AH676]
                                                      (SEQ ID NO: 343)
MKSLYAIDVGIGFTKRAYRQDVDSEMTIKSEASTLAPVPNHAESEDLTKVSFIDLDFAYY

MGNEAHQSDASFLPPFDEEIENYYESERFKQQIFGCIAKDYKENVVLPLVVTGLPVTCFG

SQHEQLQRALKKETSVQIDGKFIHITVENALILQQPVALHAYFLKEGIIQERDRILIIDGGF

RTVEMTDMKQNVILNHYEAELGCSKPLKNIKNMVQNHEGESNQLHINDMPNILEKGYE

CREENHEASQVHTLIQKELDAHFQDVMRVLQEQFKLEQYNTIIWTGGIVDLHKKRIEKM

QSEISSFRMVDASKEAALHGYYIIGSQVFEDITNQSAYESKL gi|229035414|ref|ZP_04189316.1|hypothetical protein bcere0028_54040
[Bacillus cereus AH1271]
                                                      (SEQ ID NO: 344)
MLLGNPYAIDLGNGFTKRASKKNKDLEAAVVTELSVLAPVDDYYNEAEFTKIELTNTDF

PYYIGEEARKSKLPLVRALGENKAKRYEDPTFKKQLFGFIAKDFKKNVTIPLLVTGLPVS

HFGNQRESLQKVAMEETAVKVNGELITIKVKQCLVIPQPVGTQYYLVKKEIIKKEDRILII

DGGFGTFDVTDMSGNAVIDRLGTELGCEKAFMTIEQIVRDNIGETPDLSVSNMHYILENG

YKYNGSLYDLYTHKDVAEKVDAELQRHFDAALREVSQKFNLAVYDKIVWTGGMAAL

HKKRIEKKKEQFPTFAVLENGQEANLLGYYYLGCDVFDKLTKEKASN gi|229030821|ref|ZP_04186843.1|hypothetical protein bcere0028_28850
[Bacillus cereus AH1271]
                                                      (SEQ ID NO: 345)
MKSLYAIDVGIGFTKRAYQQDVDSEVTIKSEASTLAPVPNHAESDDLTKVSFIDLDFAYY

MGNEAHQSDAAFLPPFDEEIENYYESEQFKQQIFGCIAKDYKENVVLPLVVTGLPVTCFG

SQHEQLQRALKKETSVQIDGKFIHITVENALILQQPVALHAYFLKEGIIQERDRILIIDGGF

RTLEITDMKQNVILNHYETELGCSKPLKNIKDILQNHAGESNQLHINDMPNILEKGYGGR

EENHQTSQVDTLIQKELDAHFQDVMRVLQEQFKLDQYDTIIWTGGIVDIHKKRIEKMQG

EISSFRMVDASKEAALHGYYMIGNQVFDDITNQSAYESKL gi|229030425|ref|ZP_04186465.1|hypothetical protein bcere0028_24950
[Bacillus cereus AH1271]
                                                      (SEQ ID NO: 346)
MSILLKAGADAGNNGLKLMVKGQDPIFIPSIYSLYIGEPTGLLDEGDVSLSELENHIDVTI

SSPSLMLNNVRYIVGEKVIQDQLKGTEVEKKSNKSTDELMVITILSGLAVSAMRQSPTSS

HINIRYDLSVALPMQLITQEIAAGNAKRYMGNHKVVFHYPNGRDVTINISIEYCKCLPEG

ASGTWGIVYDEEGNVVKHKIECEQNQVSEIDFVDKTLLSFDIGAGTTEEVVSLGVNFRPQ

LSKGLSYGVKETLLQIITRWNRKYPTKTIDSITEFNQIYLHEKHPRNALLVEESQPALLGL

AARVATDIINKIDDMKDDPYVFIYGGGAVIIKNSLKMILKQKGRLTNVIFVDNPLFTNAR

GLLVYTCSPKYREHKQKELGFTNLTIS gi|229009322|ref|ZP_04166606.1|hypothetical protein bmyco0002_60080
[Bacillus mycoides Rock1-4]
                                                      (SEQ ID NO: 347)
MKIGRKVADFGNSFNNFMVDGYYIELATNVVKISKKKAEDLLVDRISRPEDLLDRLLIST

EIDGEESFYLVGQLAEDNQLANSHVNKMHDKINSPIPYISFLGAIAYYHALNAEQEDNVV

EIENMSMMLPIWLLKREEKFSIAHKKMEERFTGEHKVKVLTPGMERELTITVNSAKCKN

ESEVARHSLKYKMVSKDKNTSVISIEKRYESERFDDYEVVLTDIGGGSTDAVRLGKGLT

TPKHRDSFQVIDVEPFLGYLERFRKEKLIQYFKDLRTLEKFIVNNYKEQKYVLSNENTGE

EYDFTTEIVEALKEYARILVAKVLDVFIPSSTNTVLKFIYIGGEAPVLEPYIRLALLDHMSE

TAAKNNHFFLNDIIQNSEKEVFAPTSRTINLAALELKAIDEMKGQLA
```

-continued gi|228995195|ref|ZP_04154917.1|hypothetical protein bpmyx0001_58160
[*Bacillus pseudomycoides* DSM 12442]

(SEQ ID NO: 348)

MKLNYFVEDDNGNSEKKITINGEMMKFPNTYSYVYKDPVPQDKKIEELVHGLIRNMDV

TVNSSALKGQVAQRIFVGERAIRSGADLQNLNIRSNRGKHKQDTTIMTTVSAIACRAVQ

DMFNKENSLEEGTNVEVNVLMVTALPASEWTKEKAKQLSDRFTNSSHHVTVTVGDVRI

YVTLKFDKVIVVQEGTVALFALIEDGKGNYRDDDLFNEFKEMYNLKNITGEYFQEKRLL

HIDIGDGTTEYVVTKGYDYDNDHSSGERHGIGHAIERAKKDFEDEWGFSVERQEFAGYL

KEVHPKYYDDAKKFLARAKFNLADEVLDTAETKLQDLKYDVDVVCVYGGGSIQLKEN

LFEELKEICDSKKIKILWINPKNATEMNVKGMTVFSSIALQTEQVN gi|228994350|ref|ZP_04154236.1|hypothetical protein bpmyx0001_50640
[*Bacillus pseudomycoides* DSM 12442]

(SEQ ID NO: 349)

MKIGRKVADFGNSFNNFMVDGYYIELATNVVKISKKQAEDLLVDRISRPEDLLDRLLIST

EIEGEESFYLVGQLAEDNQLANSHVNKMHDKINSPIPYVSFLGAIAYYHALNAEQEDNE

VEIEHMSMMLPIWLLKREEKFSIAHKKMEERFIGEHKVKVLTPGMEKELTIRVNSAKCR

NESEVARHSLKYKMVSKDQNTNVISIEKRYESERFDDYEVVLTDIGGGSTDAVRLGKGL

TTPKHRDSFQVIDIEPFLGYLERFRKEKLIQYFKDLRTLEKFIVNNYKVQKYVLSNENTGE

EYDFTNEIVEALKEYARILVAKILDVFIPSSTNTVLKFIYIGGEAPVLEPYIRLALLNHMSE

MAAKNNHFFLNDIIQNSDKEVFAPTSRTINLTALELKVIDEMKGQLA gi|228988741|ref|ZP_04148822.1|hypothetical protein bthur0001_53920
[*Bacillus thuringiensis* serovar *tochigiensis* BGSC 4Y1]

(SEQ ID NO: 350)

MKSLYAIDVGIGFTKRAYRQDVDSEVTIKSEASTLAPVPNHAESEDLTKVSFIDLDFAYY

MGNEAHQSDASFLPPFDEEIEHYYESEQFKQQIFGCIAKDYKENVVLPLVVTGLPVTCFG

SQHEQLQRALKKETSVQIDGKFITITVENALILQQPVALHAYFLKEGIIQERDRILIIDGGF

RTLEMTDMKQNVILNHYETELGCSKPLKNIKNIVQNHAGESNQMHINDMPNILEKGYG

GREEDPQTSQVDTLIQKELDAHFQDVMRVLQEQFKLEQYDTIIWTGGIVDLHKKRIEKIQ

GEISSFRMVDASKEAALHGYYMIGSQVFDDITNQSVYESKL gi|228943103|ref|ZP_04105591.1|hypothetical protein bthur0008_57000
[*Bacillus thuringiensis* serovar *berliner* ATCC 10792]

(SEQ ID NO: 351)

MVEQMLSKNMLLGGFDTGNIKAKISFLNEKGNIESFAIPTVIAEAPPAKIDLKSAPSKKN

DYVNEKDEDIELLHVRIISNSLDGDARSRAWYVGAYAKDQEDRQEPTVDEMGKTEDKF

SQKNKKLHLIPLFTSMAVAAARIGKEEVFVPFSGGMPIEDYKLRGEEQILEMLYGEHTVE

FLDGTYEGKKIKITINDGTMNVEGVSSVLAILFDIVNGEIVEVEGMDAEIGESYAINDLGA

GTSDNAFFEDGELNKKLSTNTDLGTNKYIDEILKNIKERFMENEILKSFMTDEIESPFKTR

EDFIQRLVMPEVEKMIEDDTYKPTFSVKWGPVKENVTDIVMDGMLKYAEDQKASLMK

FWFKTNADKNIVVGGGVLFGYAGLRDLKEQDGFILPKNIQESAYFTSRSYLIANLLEQLN

KEGVEA gi|228940222|ref|ZP_04102793.1|hypothetical protein bthur0008_28710
[*Bacillus thuringiensis* serovar *berliner* ATCC 10792]

(SEQ ID NO: 352)

MKSLYAIDVGIGFTKRAYRQAVDSEMTIKSEASTLAPVPNHAESEDLTKVSFIDLDFAYY

MGNEAHQSDASFLPPFDDEIENYYESERFKQQIFGCIAKDYKENVVLPLVVTGIPITCFGS

QHEQLQRALKKETSVQIDGKFIHITVENALILQQPVALHAYFLKEGIIQERDRILIIDGGFR

-continued

TLEMTDMKQNLILNHYETELGCSKPLKNIKNIVQNYEGESNQLHINDMPNILEKGYECR

EENHETSQVHTLIQKELDAHFQDVIRVLQEQFTLEQYDTIIWTGGIVELHKKRIEKMQSEI

SSFRMVDASKEAALHGYYIIGSQVFDDITNQSAYESKL gi|228942652|ref|ZP_04105183.1|hypothetical protein bthur0008_52780
[*Bacillus thuringiensis* serovar *berliner* ATCC 10792]
(SEQ ID NO: 353)
MDLMEIKTYSIDLGNGYTKRIVNGECIVEPSVIADVESYFSDDVDVTTLQLSEGEAYFTG

DDVGILGLKPISALGEHDMDRYETPEFKKMIFGFLAKDFKQDVTIERLVTGLPVQHFKTK

GKIVEELLKGRTVVKVNDKDIIIDIKNVSIIPQPIGTYLHLVAKKAVTPNKDLTLIVDCGH

GTLDVTELKGKTIVKRAGNNEGAKEAYINIYNTLVEEYGSLKELTISNIQNILLDGLLVSG

SRINVRAKSEVQKILKKHFNSIFTFLQDNKFDLRSYDKVVFTGGIVHLYHDYFGERAEAN

FLVVEDGQTANARGYHEYGKAMTKK gi|228969497|ref|ZP_04130308.1|hypothetical protein bthur0004_61720
[*Bacillus thuringiensis* serovar *sotto* str. T04001]
(SEQ ID NO: 354)

MGNGYTKRIVNGECIVEPSVIADVESYFSDDVDVTTLQLSEGEAYFTGDDVGILGLKPIS

ALGEHDMDRYETPEFKKMIFGFLAKDFKQDVTIERLVTGLPVQHFKTKGKIVEELLKGR

TVVKVNDKDIIIDIKNVSIIPQPIGTYLHLVAKKAVTPNKDLTLIVDCGHGTLDVTELKGK

TIVKRAGNNEGAKEAYINIYNTLVEEYGSLKELTISNIQNILLDGLLVSGSRINVRAKSEV

QKILKKHFNSIFTFLQDNKFDLRSYDKVVFTGGIVHLYHDYFGERAEANFLVVEDGQTA

NARGYHEYGKAMTKK gi|228968718|ref|ZP_04129686.1|hypothetical protein bthur0004_54810
[*Bacillus thuringiensis* serovar *sotto* str. T04001]
(SEQ ID NO: 355)

MVEQMLSNNMLLGGFDTGNIKAKISFLNEKGNIESFSVPTVIAEAPPAKIDLKSAPSKKN

DYVNEKDEDIELLHVRIISNSLDGDARSRAWYVGAYAKDQEDRHEPTVDEMGKTEDKF

SQKNKKLHLIPLFTSMAVAAARIGKEEVSVPFSGGMPIEDYKLRGEEQILEMLYGEHTVE

FLDGTYEGKKITITINDGTMNVEGVSSVLALLFDIVNGEIVEVEGMDAEIGESYAINDLG

AGTSDNAFFEDGELNKKLSTNTDLGTNKYIDEILKNIKERFMENKILKSFMTDEIESPFKT

REDFIQRLVMPEVEKMIEDDTYKPTFSVKWGPVKENVTDIVMDGMLKYAEDQKASLM

KFWFKTNADKNIVVGGGVLFGYAGLRDLKEQDGFILPKNIQESAYFTSRSYLIANLLEQL

NKEGVEV gi|228966097|ref|ZP_04127160.1|hypothetical protein bthur0004_29130
[*Bacillus thuringiensis* serovar *sotto* str. T04001]
(SEQ ID NO: 356)

MGNEAHQSDASLLPPFNEEIENYYESERFKQQIFGCIAKDYKENVVLPLVVTGLPVTCFG

SQHEQLQHALKKETSVQIDGKFINITVENALILQQPVALHAYFLKEGIIQEQDRILIIDGGF

RTLEMADMKQNLILNHYETELGCSKPLKNIKNILQNHAGESNQLHINDMPKVLEKGYEC

REENHETSQVHTLIQKELDAHFQDVIRVLQEQFTLEQYDTIIWTGGIVDLHKKRIEKMQS

EISSFRMVDASKEAALHGYYIIGSQVFDDITNQSAYESKL gi|228962371|ref|ZP_04123775.1|hypothetical protein bthur0005_57060
[*Bacillus thuringiensis* serovar *pakistani* str. T13001]
(SEQ ID NO: 357)

MKSPYAIDLGIGFTKRAYRKHVNSPTTIKSEASTLAPVPIEDESENLTKVSFMDVDFAYY

MGEEAHQSEASFLPPFEEDIEHYYESNRFKQQLFGCIAKDYQENIVLPLVVTGLSLSCFG

KQHEQLQKIIKKETSVQLDGKFITITVENALLLPQPIALHAYFVEESIIQERERVLIIDGGFR

-continued

TLEITDMKQQLILNRYETELGCRKPLKKIENILREHVGESPTLHLHNLPDILDKGYICKEEI

HCLQTSPISALVQKELNAHFQEILDVVQEQFLFHQYDKIIWTGGVVDMHKKRIQEKQGA

YPSIHILEPAKEAALHGYYILGCRVFEDIVQQPV gi|228962224|ref|ZP_04123662.1|hypothetical protein bthur0005_55780
[*Bacillus thuringiensis* serovar *pakistani* str. T13001]
(SEQ ID NO: 358)
MMNKDAGNSLDMNLIDGFYIETPTNVVEISKDEANSHFVATITNPKELLSRLLISTTIPEE

DTERFFLVGDEASKHALANNHVNKLHDKTTSPIPYIMFLSAISFYHAINETRESDENTIEIE

YFQTMLPIWLLKRTAKFSEAQHAMAARFTGEHEVTIHTPGMEKTLKIIVEKAICRIEGEIA

RLAIKKNFELEDREEARQFDDNDTVLVDIGGGTIDLVLSPAGLKSPKNRDSMQPIDKLSY

LSHIEKLRKEKFLEKFSDLRSFETFIVNNYQKPKMELVDGNTGQRIDLTEKIQSSLKEFAR

FLILKIQDVIPAPSDKVYKYVYFGGVAPILKTNIHEVIEEMYGAEIAQANHIFLPDSRKLN

LYGLEIKSRGEMLQKTKK gi|228961763|ref|ZP_04123365.1|hypothetical protein bthur0005_51990 [*Bacillus thuringiensis* serovar *pakistani* str. T13001]

(SEQ ID NO: 359)

MMRTVADIGNSELKMVINGGKVIKLPDVNKRVFGRVTNKEGSLKQSVTNLMNEICVHV

TSDAIERDGKFYVGYRAAHSNGKPDALDIELGDKYKRDIPVVNVLSVMATKAVQTIYEE

VGELPKSIEVPASLILAIPASEYEGKKARFLESRFKENVHIVIVYVGEEKVTVQIKFETVKV

TREGIPALYAIFEGNQDMFDDFNKLYKKETDSKEDDKEVKKRKANLMVEEEVNGEYFK

NKKILHADIGDGTSEYIFSKGLNPVPDACWGEKRGIGHAIEGAIKLLQEEYEGGVDINRQ

QFSELVTDPNDKKHDKAVEFLEETRYMQAQGIYDDIEKAYVYKTASQAEVLAVYGGGS

IALKEDLYKKAFEFCEVNDMQLLWISPTYATEMNVRGMEILSKKLASRVAKK gi|228959387|ref|ZP_04121078.1|hypothetical protein bthur0005_28730 [*Bacillus thuringiensis* serovar *pakistani* str. T13001]

(SEQ ID NO: 360)

MKSLYAIDVGIGFTKRAYRQDVDSEMTIKSEASTLAPVPNHAESEDLTKVSFIDLDFAYY

MGNEAHQSDASFLPPFDEEIENYYESERFKQQIFGCIAKDYKENVVLPLVVTGLPVTCFG

SQHEQLQRALKKETSVQIDGKFIHITVENALILQQPVALHAYFLKEGIIQERDRILIIDGGF

RTVEMTDMKQNVILNHYEAELGCSKPLKNIKNIVQNHEGESNQLHINDMPNILEKGYEC

REENPETSQVHTLIQKELDAHFQDVMRVLQEQFKLEQYNTIIWTGGIVDLHKKRIEKMQ

SEISSFRMVDASKEAALHGYYIIGSQVFEDITNQSAYESKL gi|228953457|ref|ZP_04115502.1|hypothetical protein bthur0006_28360 [*Bacillus thuringiensis* serovar *kurstaki* str. T03a001]

(SEQ ID NO: 361)

MKSLYAIDVGIGFTKRAYRQDVDSEVTIKSEAATLAPVPNHAESEDLTKVSFIDLDFAYY

MGNEAHQSDASFLPPFDEEIENYYESEQFKQQIFGCIAKDYKENVVLPLVVTGLPVTCFG

SQHEQLQRALKKETSVQIDGKFINITVENALILQQPIALHAYFLKEGIIQEQDRILIIDGGFR

TLEMTDMKQNVILNHYETELGCSKPLKNIKNILQNHAGESNQLHINDMPKILEKGYGDK

EENYETSQVDILIQKELDTHFQDIMRVLQEQFKLDQYDTIIWTGGVVDLHKKQIEKMQG

EIVSFRMVDASKEAALHGYYIIGSQVFEDITNQSAYKSKL gi|228950528|ref|ZP_04112678.1|hypothetical protein bthur0007_65790 [*Bacillus thuringiensis* serovar *monterrey* BGSC 4AJ1]

(SEQ ID NO: 362)

MKMLITAAIDAGNDALKALFNGFENKLYIPNVVKEMESRQVIELGDDPLKELHVHITSS

ALKKSATYAVGTLAAKEKQSAQIPATDLKSESDQTTILMLTALAYEAASNSDKDVIDAE

FLLSTGLPVDEVKEDKRAGFKKKLLEGTHVVEFKKTPHLEGKKVRISFKDIFVNVEGFA

AMINLTISEELKSQNSELRQKNILINDMGGNTTDKAVIRMGQIDNEYSSGSPLGIGEYLDA

-continued

```
IRKEVFNTYRVDVFKSRRQLVENMTAKHEAYIIRPHGKPVSYYEIAEKHLKEFTVREYA

DLVDKWKEVGDLHSIHNVGGSAAIVKSFLEDINKNENQFEMHFLDTEESIWSIAKAYYK

LLLVIAKQKELSLN
``` gi|228950249|ref|ZP_04112426.1|hypothetical protein bthur0007_63150
[*Bacillus thuringiensis* serovar *monterrey* BGSC 4AJ1]

(SEQ ID NO: 363)

MDAGNDALKAFIGGLGEDHKVYIPNVIKKMDDRPILSLGDDPLSELHLRITSSAINISGTY

AVGTLAVKEKDSSHIPATVLKSESDQTVILTLTALAYYAAMHSKAKKVDVEYLLSSGLP

VDEVKADKRAAFKEKLIEGTHVIEFKKTPLLEGKTVNIKFRDAFMNVEGFGAVINLTVD

DKLQAINNELKQKNILINDMGGNTTDKAVIRMGRIDNEYSSGSPLGIGEYLDAIKKEVFT

TFRVDVFKSRRQLVENMTAEKEAFIIRPHGKAESYQAIAEKHLMEFAMREYADLVDKW

KEVGDLHSIYNVGGSAAIAKPFLEQINKENNQFEMHFLDTEESIWSIAKAYYKLLLIIAKQ

KGLDLKK gi|228936872|ref|ZP_04099626.1|hypothetical protein bthur0009_52840
[*Bacillus thuringiensis* serovar *andalousiensis* BGSC 4AW1]
(SEQ ID NO: 364)

MKINMMNKDSGNSLDMNLIDGFYIETPTNVVEISRDEADSHFVASITNPKELLSRLLISTT

IPGEDNERFFLVGDEAAKHALANNHVNKLHDKITSPIPYIMFLSAISFYHAINEQREPDDN

TVEIKYFQTMLPIWLLKRTAKFSEAQNAMAERFAGEHEVTIHTPGMGKTLKITVEKATC

RIEGEIARLAIKKNFELEDREEARQFDNNDTVLVDIGGGTIDLVLSPAGLKSPKNRDSMQ

SIDKLSYLSHIEKLRKEKFLEKFSDLRSFETFIVNNFQKPKMELIDGNTGQRIDLTDKLRSS

LKEFAKFLILKIQDVMPAPADKIYKYVYFGGVAPILETSIHEVIEEMYGTEIAQANHIFLP

DSRKLNLYGLEVKSRGEILQKTEN gi|228934411|ref|ZP_04097247.1|hypothetical protein bthur0009_28680
[*Bacillus thuringiensis* serovar *andalousiensis* BGSC 4AW1]
(SEQ ID NO: 365)

MKSLYAIDVGIGFTKRAYRQDEDSEVTVKSEASTLAPVPNHDESEDLTKVSFIDLDFAYY

MGNEAHQSDASFLPPFEEEIENYYESEQFKQQIFGCIAKDYKENVVLPLVVTGLPVTYFG

SQHEQLQRALKKETSVQIDGKFIHITVENALILQQPVALHAYFLKEGIIQERDRILIIDGGF

RTLEMTDMKQNVILNHYETELGCSKPLKNIKNIVQNHTGESSHLHINDMPNILEKGYGG

REENPQASQVGTLIQKELDTHFQDVMCVLQEQFMLDQYDTIIWTGGIVDLHKKRIEKMQ

GEISSFRMVDASKEAALHGYYMIGSQVFDDITNQSVYESKL gi|228904462|ref|ZP_04068557.1|hypothetical protein bthur0014_56070
[*Bacillus thuringiensis* IBL 4222]
(SEQ ID NO: 366)

MEKAQLILDLGNSETRGVLRVGEIINKTRIEHNFYLSNYFSPIFEGVGGIPESDDYTEENST

VFTLDDDFKIGNGVVNRDTYVNGLMCSNEFSDTQDKPTAMTKKYDSSYTVLTIITAIKQ

SAIWMKDYFGKKGKNFSVQQLINEVAWELTILLPPSQEKAGGLVLQETLVGQIPVKFEL

PKADARINITKVTIRAEGMMAYTGVLLSKTRRQPRPNKIFMQKAKVMVLDIGAGTTDLI

VIDQGKAIERSKYTIDLGGNNITQTLRTTVQTNLEIRLSAQVFEQGVITGKVKQGLKEHD

VTDELIGAKRSVAAKISKEVKDYLESSGIEANSIEYILVVGGGSIPSENDKVKPISDYLLDS

IKRFAPQVGLVDISDIITKPNSVAFENVADADFVSSRELNISGAGTVTDLLEIKQYLAQQE

QAKQVQA gi|228924761|ref|ZP_04087924.1|hypothetical protein bthur0011_56620
[*Bacillus thuringiensis* serovar *huazhongensis* BGSC 4BD1]
(SEQ ID NO: 367)

MTKVFAIDHGNGAVKMRTDVFKKTLPAIYSFSSNVGEALSGGKMKLKTYKVEGTEYV

WGDDIIKVNNTLNTYAQQNRYKTNQYKTLSKIALAEMAAKTNVKSYDEILVVTGVPSQ

-continued

EIGTKAVDEIKEVYQGTHELEVNGKKVTLNVVDVIVLAQPVGTVMSRYLDEDGFVADD

SYEDMTVGIIDIGTGTTDLDVISMLRREKESTSVPKGMHDVYEPIVAKIKKETSATINDYK

LEKVFEEGAYQASKRMDPIDFNDEKTASIKEVYDFIVNGVNNAWKTFDRFDEVLVSGG

GANTFHELLEEWIGKVTKLEESQTANVEGFYRYGKFEVGEEDGE gi|228921815|ref|ZP_04085130.1|hypothetical protein bthur0011_28110
[*Bacillus thuringiensis* serovar *huazhongensis* BGSC 4BD1]
                                                      (SEQ ID NO: 368)
MKSLYAIDVGIGFTKRAYRQDVDSEMTIKSEASTLAPVPNHAESEDLTKVSFIDLDFAYY

MGNEAHQSDASFLPPFDEEIENYYESERFKQQIFGCIAKDYKENVVLPLVVTGLPITCFGS

QQEQLQRALKKETSVQIDGKFINITVENALILQQPVALHAYFLKEGIIQERDRILIIDGGFR

TLEMTDMKQNLILNHYETELGCSKPLKNIKNIVQNHTDESNQLHINDMPNILEKGYECR

EENHETSQVHTLIQKELDAHFQDVMRVLQEQFKLEQYDTIIWTGGIVDLHKKRIEKMQG

EISSFRMVDASKEAALHGYYIIGSQVFEDITNQSAYESKL gi|228915737|ref|ZP_04079319.1|hypothetical protein bthur0012_29560
[*Bacillus thuringiensis* serovar *pulsiensis* BGSC 4CC1]
                                                      (SEQ ID NO: 369)
MKSLYAIDVGIGFTKRAYRQDEDSEVTVKSEASTLAPVPNHDESEDLTKVSFIDLDFAYY

MGNEAHQSDASFLPPFEEEIENYYESEQFKQQIFGCIAKDYKENVVLPLVVTGLPVTYFG

SQHEQLQRALKKETSVQIDGKFIHITVENALILQQPVALHAYFLKEGIIQERDRILIIDGGF

RTLEMTDMKQNVILNHYETELGCSKPLKNIKNIVHNHAGESDHLHINDMPNILEKGYGG

REEDPQTNQVHILIQKELDAHFQDVMRVLQEQFKLDQYDTIIWTGGIVDLHKKRIEKMQ

GEISSFRMVDASKEAALHGYYMIGSQVFDDITNQSVYESKL gi|228908908|ref|ZP_04072739.1|hypothetical protein bthur0013_30650
[*Bacillus thuringiensis* IBL 200]
                                                      (SEQ ID NO: 370)
MKSLYAIDVGIGFTKRAYRQDIDSEMTIKSEASTLAPVPNHTDSEDLTKVSFIDLDFAYY

MGNEAHQSDASLLPPFDEEIENYYESERFKQQIFGCIAKDYKENVVLPLVVTGLPVTCFG

SQHEQLQHALKKETSVQIDGKFINIKVKNALILQQPVALHAYFLKEGIIQEQDRILIIDGGF

RTLEMADMKQNLILNHYETELGCSKPLKNIKNILQNHAGESNQLHINDMPNILEKGYEC

REENHETSQVHTLIQKELDAHFQDVMRVLQEQFKLEQYDTIIWTGGIVDLHKKRIEKMQ

GEISSFRMVDASKEAALHGYYIIGSQVFDDITNQSAYESKL gi|228905653|ref|ZP_04069581.1|hypothetical protein bthur0014_66980
[*Bacillus thuringiensis* IBL 4222]
                                                      (SEQ ID NO: 371)
MMNKDSGNSLDMNLIDGFYIETPTNVVEISKDEADSHFVATITNPKELLSRLLISTTIPGE

DTERFFLVGDEAGKHALANNHVNKLHDKITSPIPYVMFLSAVSFYHAINETRESDDNTV

EIEYFQTMLPIWLLKRTAKFSEAQNAMAERFAGEHEVTIHTPGMEKTLKITVEKATCRIE

GEIARLAIKKNFELEDREEARQFDNNDTVLVDIGGGTIDLVLSPAGLKSPKNRDSMQPID

KLSYLSHIEKLRKEKFLEKFSDLRSFETFIVNNFQKPKMELVDGNTGQRVDLTDKIRSSL

KEFAKFLILKIQDVMPAPADKVYKYVYFGGVAPILETSIHEVIEEMYGAEIAQANHIFLPD

SRKLNLYGLEVKSRGEMLQKTEK gi|229587486|ref|YP_002860524.1|hypothetical protein CLJ_0217
[*Clostridium botulinum* Ba4 str. 657]
                                                      (SEQ ID NO: 372)
MNKYTIAIDLGYGQIKGINQDNKRVIFPSIISSGKDRSLDTFFNSIDNIVDNIHVKILDEYFN

EKEYFVGELAKRQPSNSSFINRDNKINSEENKVLLATALGLLIPNDLSNDTKIHIVTGLPL

EHFIKQKQALNDMLKDFEHTIKFVDHNFSRNIKFEESNITLFPQGAGAIFSKINNDISSLLI

KETFIGLIDVGFKTTDIVVFRINKDKEPVFEQEMSATLDGLGMINIYNTMDKAFTDNSRD

GSKLNTEQLMLLCEEGKIFFKGDYIDLKKDLIKARKTLSTNIINKADGLWGSRKNSFNSI

MIAGGGGKVLYNHLKLIEPNMCQLIDNPEFANAIGYLEFGKQFK gi|229542391|ref|ZP_04431451.1|hypothetical protein BcoaDRAFT_4956
[*Bacillus coagulans* 36D1]
(SEQ ID NO: 373)
MGKTRIAAVDVGNDSLKGIFGKMEYELNIPNVIARDIEDRPVIGIEELDSKDPLEGIHVKV

HSPALKENNVIYRVGDLATKSDNATELDPGSSKSEEDQTLVLLFTSLALDAVREENAKV

FTRNQNVIDANYTLGTGLPLREVKEGKDAGYRSQLLGSVHQVEFLVTPKYQGLKVNLK

FDEIKVYPEGFAAFINLVMDNDLNIINRELIDKRILIQDIGGLSTDIAVIKNRTVDDDRAQG

FNLGVSEALEQIREEIRVKYGVELDSRRDVVDIITKKHDRNHIMVKGSRTSVHDITDRILF

DLAKKQYRLLRNVWQKNSQTEICYFVGGGSVVLKDYLKTLNNSLDGYNIDFFEDEKESI

WMMANAYYKLISDYVRKNNKPEDKGKKPVESK gi|229516089|ref|ZP_04405539.1|Rod shape determination protein
[*Vibrio cholerae* RC9]
(SEQ ID NO: 374)
MEDFMSQFVLGLDIGYSNLKMAMGYKGEEARTVVMPVGAGPLELMPQQLTGGAGTCI

QVVIDGEKWVAGVEPDRLQGWERELHGDYPSTNPYKALFYAALLMSEQKEIDVLVTGL

PVSQYMDVERREALKSRLEGEHQITPKRSVAVKSVVVVPQPAGAYMDVVSSTKDEDLL

EIIQGGKTVVIDPGFFSVDWVALEEGEVRYHSSGTSLKAMSVLLQETDRLIQEDHGGAPG

IEKIEKAIRAGKAEIFLYGEKVSIKDYFKKASTKVAQNALIPMRKSMREDGMDADVVLL

AGGGAEAYQDAAKELFPKSRIVLPNESVASNARGFWFCG gi|237667571|ref|ZP_04527555.1|conserved hypothetical protein
[*Clostridium butyricum* E4 str. BoNT E BL5262]
(SEQ ID NO: 375)
MITVVDLGNYNVKAMNSLTAKSIFKSNISRDYESYPDAFKHIKIDGEYTYFEKGPFSMEY

IKTKKDYTAQLMYAIASLNEAEDEIKTNLTLLLPISEIQEKHKYIDEIKGKTFNCSVKLKT

KINKNITIEDVMVLPEGYVIYFKLGEKYKTSSIVIVDIGGRTTNLVAMVNGEPKVLKTLKI

GALDFYAKIRELHADKEYNLEDIERLIKEGKVVVTDKQIAQFANDILNQIKQHIKLEHYE

HVLFAGGGAIIIEKIIKDILPDNCEIVDEPLESNMEGAMEASKMAWNE gi|242308945|ref|ZP_04808100.1|conserved hypothetical protein [*Helicobacter pullorum* MIT 98-5489]

(SEQ ID NO: 376)

MQKIAIDLGYGDTKVMANGKLFKFPSAISQVRQSLIQAEKKDTFLFNGIEYEVGSKALR

NAVATRGYLFLQKYSPLLIFNALLEAQFDLKKPIEIATGLSLVNQSEAQDFLKHIESFVVN

DIQIKPQISLFAQGQGIYNEANIQSNGLVCVIDIGYNTFDFLVFENNQPKVELCFANKMGA

NLAIVDLQKLLIKEFKVDFSEQEAKEVFLKKEVRIAGKSIDFADIVNSAIQNYTNFIFDELF

SKSGDTLKKAEAVIIGGGGAYFLTKEHLEQVHNANYVFSDNPEFANVRGYYKGSFSNKE gi|240141815|ref|YP_002966323.1|hypothetical protein MexAM1_META2p0044 [*Methylobacterium extorquens* AM1]

(SEQ ID NO: 377)

MAEAAMKKERGAKEGVQPLVAIDDGYAQTKLYGEGLDGRIVKRVLRSSVRIGSHGLGS

FAGDGAIGLWQTEEGNKYTVSDEIEAEDPRFTDFHLSPINRVLVNHALSAAGFGGAKVD

IVTGLPVKEFFKEQRKDEERIQRKRENLQRGAFSRSAGVEAPVLADIQVGCQAIAAFVD

WALDDEMKTRNDIAKTIAIVDIGGRTTDVAVVVGGKSIDHGRSGTADVGVLDVYKGVL

DRVKGRFELDDDSLPLSLMNEAVRTGSMQLFGKPHDVSEIVSDVVGQVQERALREIQRR

LGRAATLQAVVFVGGGSALFKDIASAYPNGVMSDDPEFANARGLYKYFASRRRS

-continued gi|241762997|ref|ZP_04761059.1|conserved hypothetical protein
[*Acidovorax delafieldii* 2AN]
(SEQ ID NO: 378)

MELIVRAVDVGSGNTKLVTGVAGADIRCASFPSVAYPSSGETPQWPASERRKTFCIPVGP

LFYEVGPDVGLAADTFRAKQLHDEYTESPEYMALLRGALSMMKVPHIDLLIVGLPVALF

TLKKAALEKAMVGSHQVGGGKTVTVAKAMAVAQPQGALVHYAAEHQKIESIGTEQSL

VIDPGSRTFDWLVTRGMRLVQKQSHSINRGMSDVLRLLAAEVSKDLGTPYRDYDAIDL

ALRTGKAPVIFQKPYDMKRHLPLAESVAQQAVSTMRQWIETPESLQNIILVGGGAFLFK

KAVKAAFPKHRIHEVKEPMFANVRGFQLAGQNYAASTMAPGRDRGAGEAA gi|241762722|ref|ZP_04760786.1|conserved hypothetical protein
[*Acidovorax delafieldii* 2AN]
(SEQ ID NO: 379)

MWERSLHADYTGTDSYKALFHAGLLLTSATEIDVLVTGLPVSQYQDESRRKALEKQFT

GKRKITPKRTVEAASVKVVAQPIGGLFDMVNQDESQGEDGDIDEEARILVVDPGFFSLD

WVLVSNGEFHRQSSDTSLKASSVLLEQAGLLIAQDYGAKPTVEALENAVRAGITSILMM

GQRVDFGPYLKRAGESMSSTIANSIQKSLRNEKMSPDIVVLTGGGADFFRDIIQDAFPRL

KVVSPKESVLSNARGFWLLGSIN gi|242262841|ref|ZP_04807504.1|StbA family protein [*Clostridium cellulovorans* 743B]
(SEQ ID NO: 380)

MIMGIDVGYSHTKVYTSNGRDIFRSTVTNGIMDINVNAIKVKIAGNEYTVGENTGNFSV

KLNKIDDAVFRLCLYTAVARNLPIGEDEVQLVIGLPVQYYKDQKLELKKALEGIQVFLSL

NDKPIRFKITKCVVFPQSAGVFVLHPDIFEGSNIVIDIGGMTVDVSYFNDMTLQDYRTYE

LGMIKLYDKLVQNIKAEFGVSYDILNAEDIIKNKRIFRDGELIDCTDVVNTTLRTHASLIIN

RVMAGLSQYDTSQRHFIGGGSYILGEYLPVKAIKEDIYANAEAFFKIGVERFAS gi|242262130|ref|ZP_04806818.1|StbA family protein [*Clostridium cellulovorans* 743B]
(SEQ ID NO: 381)

MILGIDIGNYSVKTSTGVNFKSLVSTEENLLGSKIKIEFDNKTFYIGEGNRDTELDKASKE

SFLPLLYSAIALSSPAQYNKVVVGLPINQYKSRKAEIENKISKESNKKIILNDKERTLTITEF

KVYPEGVGAYQSLDSEEDMIIIDIGGRTTDIAYIFNGELKTTSTVNVGTLNIYKNIADQLN

SKFSIDIDVEKAEKIIKQGYLSIDNKTVDISFVSSVLRENFMKIKADLDFKFSAHTEKLML

TGGGAALFHKAFVNRYEDISIMQNPVLANVRGFKKVGELLWV gi|242348095|ref|YP_002995656.1|hypothetical protein pRA1_0158
[*Aeromonas hydrophila*]
(SEQ ID NO: 382)

MSQFVLGLDIGYSNLKMAMGHKGGEARTVIMPVGAGPLELMPQQLTGGAGTSIQVVID

GEKWVAGVEPDRLQGWERELHGDYPSTNPYKALFYAALLMSEQKEIDVLVTGLPVSQY

MEVERREALKARLEGEHQITPKRSVAVKSVVVVPQPAGAYMDVVSSTKDEDLLEIIQGG

KTVVIDPGFFSVDWVALEEGEVRYHSSGTSLKAMSVLLQETDRLIQEDHGGAPGIEKIEK

AIRAGKGEIFLYGEKVSIKDYFKKASTKVAQNALIPMRKSMREDGMDADVVLLAGGGA

EAYQDAARELFPKSRIVLPEESVASNARGFWFCG gi|251777976|ref|ZP_04820896.1|probable ATPase of HSP70 class,
putative [*Clostridium botulinum* E1 str. 'BoNT E Beluga']
(SEQ ID NO: 383)

MLIGVDLGNFGVNTSENDFFYSRISDISNFSEENKITYEGIDLYIGDGEFSTNWNKSQKEN

TMPLLFSALARSSNENFFQIVLGLPIQQYKSNKDEFKKYIEDNRGKTIIYKGIKREIIISDVL

IAPEGAAAYYNLSAEQKKLIGNKSLIIVDIGGRTTDVCMFQNKEIKKFKTIPTGMLNIYAD

IVTEVNNRFTESFKLEEGENILKEGLFLYGEKQDINFVKPILQRHFNSIYKDLQLNFELSK

GYVLLTGGGSLILKRPFENRLKNLIISKDPVFDNAKGFKKLGTSIWQEK gi|251779917|ref|ZP_04822837.1|conserved hypothetical protein
[*Clostridium botulinum* E1 str. 'BoNT E Beluga']
(SEQ ID NO: 384)
MSEKIKVLVSIVDLGNYNVKGINQDGKKIDFKSNISKNYETFPDGFNYVLLDGEYTYFEK

GVFSKEYIKTNKDYTAQVLYAITKLHEDIEDIETNLTLLLPISEMEHKQKYIDELKGKTFE

YTVKASKKMEKTVKINDVLVIPEGYASYFTLEDEVKTSAVLLIDVGGRTSNVVAMNNG

KPQVLTTYKIGVLNFYSKLKKLNEDKEYNLEDIERLIKKGDITITQKQLATFTNDIINEIKI

DVNLNHYDNVVWTGGGSTVIEKVITENLPESCSLNKEPLYSNINGALEVSKITWGIKDG

KEEKK gi|251780072|ref|ZP_04822992.1|phage uncharacterized protein, XkdX
family [*Clostridium botulinum* E1 str. 'BoNT E Beluga']
(SEQ ID NO: 385)
MENNNGLVRITVVDAGNYNMKYMGKGEMGSFSSKVSTDEQPFNDAYDRIEIDGKITYI

GQFGELSREYNKVDRNLLPQILFAICKANNDVDTITTNITTMLPILQMTNKSKIIEQLKSQ

NPFKVKVNGKDKTIFIKQVAVLPESFTSFYDMTKEQQKEDVCIVDCGSRTVNVCTFINN

GKLEKTATLKLGSLDFFKKVKSIEASKGKDYVEEDIERLINNGKITVAEKQYKDFFNEIL

NSIKADVNIDNYATYFTGGTAKMFQKYIPNGCKLFVNPLYSNLNGALKASELKWGKVV

NG gi|251770901|gb|EES51487.1|conserved protein of unknown function
[*Leptospirillum ferrodiazotrophum*]
(SEQ ID NO: 386)
MKKAGQNKETLKIENIGLDDGYANIKLAWKDEDGTIRTKKVPSRAKAGSLGVGSLLDD

GPGAAMGYETEGERWTVAPGIEGESTRFPDYNLSSLARVLAHHALVSAGWGGKDVGIA

TGLPLDRYFRDGKRDDVRIARKIENFSKDVIRLDGGATARIVGHEVFAQGLAAVVDWL

VDDSDPREQIGPIGVVDIGGQTTDISVVSPGFQVDRGRVRTVDLGVLDVRDLLRRRLQSR

FDVYEISDGAIDAALAFGKIRVWNKEVDVIDDTAQVVREVESSLERNILSEFGKAASSFE

TILFVGGGSRIFRSLPARFPNAVVGPDPEFANARGLLKIRILNERLNKRGSRS gi|251828787|ref|ZP_04831849.1|conserved hypothetical protein
[*Gallionella ferruginea* ES-2]
(SEQ ID NO: 387)
MLTVGLDIGYSNLKIVYGDNTEVSPKMIKRPAGAAPLDHLGQRIMGSDDSLHVLVDGK

EFAAAVSHDRIENWPRELHKDYTATESYRALFNAGLLLTEMSEIDCVVTGLPTNQYLDA

GLREHLTKIMRGEHQITPRRKVVVHEVKIVPQPLGGFVDWMHGLNDPSQIEDSSVLVVD

PGFFSVDWVLLVNGEFKRASSGTSLDATSVVLDEAAALIAKDHGGNPGRSKLENAVRA

ERSTVSVFGERIEIAPYLADASAKVGHIACSQIQESLRKENSSIDQIVLVGGGAPFFEASIK

EAFAKTPINLAKEAVFANARGFWRGGAA gi|253576814|ref|ZP_04854140.1|conserved hypothetical protein
[*Paenibacillus* sp. oral taxon 786 str. D14]
(SEQ ID NO: 388)
MIGNVLFPRCEEVIMIRIAGIDVGNDSVKVVVDGSQRPIIIPSIVSPGYDRHVLQEEDSPLK

ALDVRVYSPKLKRNNQRYFVGLLAMEDQDNSELEETDNKATSDQSLVVALTALAYAA

LAGQTYPTTGTGIEEVEYILGTGLPVRTYVAFHKAFEERLTGEHEVTFLSTPELRGRTVRI

NIRRTIVSVEGAAALFHLATNDTLQVRNEELHNGCIGICEIGALTTDFPVVKRMNIDNQFS

TGEQFGLATYLDSIIRDVEDQFGYRFPSRTKLIGRIRNREFIIQRVGEGQADIRPIVDMYFS

RAAQKLVDLIRKRWKKYPDIECFYVLGGGAAALKSYLIEAAGPMRLRFEENSEILNVQG

YLKLAKNKAGQQPNPA

-continued gi|253680878|ref|ZP_04861681.1|conserved hypothetical protein
[*Clostridium botulinum* D str. 1873]
(SEQ ID NO: 389)
MSKGNNIVDSFAVQVIDDGYADTKSRSENTNIIVTPSYVTSWRPSYNKDNDLKEGKVDK

LSRIEVNVNGSKFLVGECAVKQDRNIQWNGASDKHDDTSFDILLKTHLSLLNKKPMSRV

KLVMGLPVIASLDKERVDKMKAKVLRQHDVAMRLCGDKEFQNKIIKVEDLIIKAQPHG

TLCDLILDNSGNLTNKDLAKKVNAISDIGGKTHNLYLVDALEPLADFCDTKNSGMYLAY

MWIKNYIEQELHLSISDGQIQYIVASGHIKGYDLTPVIQKAYRSLARKIILEIRTVWENAFP

FIENIIFTGGGATVLKPYLQEEFKNAMYLTRNQNAAGLFKQGIRKWKRKAV gi|254723117|ref|ZP_05184905.1|hypothetical protein BantA1_11669
[*Bacillus anthracis* str. A1055]
(SEQ ID NO: 390)
MKSLYAIDVGIGFTKRAYRQDEDSEVTVKSEASTLAPVPNHDESEDLTKVSFIDLDFAYY

MGNEAHQSDASFLPPFEEEIENYYESEQFKQQIFGCIAKDYKENVVLPLVVTGLPVTYFG

SQHEQLQRALKKETSVQIDGKFIHITVENALILQQPVALHAYFLKEGIIQERDRILIIDGGF

RTLEMTDMKQNVILNHYETELGCSKPLKNIKNIVQNHAGESDHLHINDMPNILEKGYGG

REEDPQTNQVHILIQKELDAHFQDVMRVLQEQFKLDQYDTIIWTGGIVDLHKKRIEKMQ

GEISSFRMVDASKEAALHGYYMIGSQVFDDITNQSVYESKL gi|255257264|ref|ZP_05336707.1|conserved hypothetical protein
[*Thermoanaerobacterium thermosaccharolyticum* DSM 571]
(SEQ ID NO: 391)
MFKIGLDLGYGYTKGINESDKTVVFPSIVGNAYERNLKGLFESSFEKRIDNMHIVIMNGE

RHEFFVGELARREGRNVSYAFDENKINHPNTKALIAASCLLLFPEDGSPVHLVTGLPLEQ

YIHKKDEFLEMLKGYRNLGCFKGDEKVKTIKFDKVTIFPQAAGAVYSAIMEDLHRYLIK

GSYLGLVDIGFKTTDFIVFLVEDRLILREDLSGTIDVGISSIYNSIDKLFIQKTGSKLDVPEL

MRLAKDERIFFRGRQIDFGDEIKSIKAEIARVIKDRLKAVWGNKLDFFNTIFLAGGGAKD

LQEFLVDIYDNAVIVKDPQMANAKGFLKVAELEEKKNN gi|255683548|gb|ACU27363.1|Alp7A [*Bacillus subtilis*]
(SEQ ID NO: 392)
MNISRMNVDFGNSMYMNLIDGYFFELPTNVVEISKEAAEGKFTSIVEDPADLKDRLLVS

TVIDETERYFLVGELAEPEVLGNQHIKKLHNKVESHIPYVTFLAATAYYQALKGKREDN

EVTIEYFQTMLPIWLLKKLDKFSEMQKRMASKFLGTHQVKVLTLGLEKELTIKVEDAAC

RIESEVARWAIKKNFDLEDKDYAEQFKNYDVVFCDLGGGTDDLVLLPAGLKPPKSRDSF

VSNTEAPFLAHLEKLRKEKLLEHFDSVRELEKFIYSNIGKTKMERRDGNTGQKFDLTDII

KKSLKEYTEIKIAQAENTFPAPKDKVYKYLYFGGVGEVLEESISVVTEERYGRDISESNHI

VAEDARLLNLYGLEVLSRAEQVKKQANEKEAQSI gi|258624154|ref|ZP_05719104.1|hypothetical protein VMB_04050 [*Vibrio mimicus* VM603]
(SEQ ID NO: 393)
MSQFVLGLDIGYSNLKMAMGHKGEEARTIVMPVGAGPLELMPQQLTGGAGASIQVVID

GEKWVAGVEPDRLQGWERELHGDYPSTNPYKALFYAALLMSEQKEIDVLVTGLPVSQY

MEVERREALKARLEGEHQITPKRSVAVKSVVVVPQPAGAYMDVVSSTKDEDLLEIIQGG

KTVVIDPGFFSVDWVALEEGEVRYHSSGTSLKAMSVLLQETDRLIQEDHGGAPGIEKIEK

AIRAGKAEIFLYGEKVSIKDYFKKASTKVAQNALIPMRKSMREDGMDADVVLLAGGGA

EAYQDAAKELFPKSRIVLPNESVASNARGFWFCG

-continued gi|259503757|ref|ZP_05746659.1|conserved hypothetical protein
[*Lactobacillus antri* DSM 16041]
(SEQ ID NO: 394)

MQYSAKQGEQPMEIFSLDLGNKQTKLKSSKSEYVLPSRYLNQADMPMSVGSSTTNNDL

HIYSVPFSDDKYVWGRDIDGLHLDEYLADTIMYGNRYNSEAFKLLANFALGLLASDFKI

ANNQVLEVVVTAGLPTGDYADQERLRSLLKVLEGQHQVTIDDQIVTVRVRKVYILPQPI

GTLYNELLDNQGFIKNKALLDEKVGIVDVGGGTILIDTILNFELSGKNRHQFNTGVNDLY

EAIASRIEGDVSLYQLEKELRHGNQQHQWSYRFSKNRQDDITELVGKESDRFTRRLVAN

VTSTLKNLDSIDTLFFTGGGANLINQKILKTTFTNAAIVKDTEVANVNGFYKYGLSQQVQ

EKEGK gi|259156533|gb|ACV96477.1|conserved hypothetical protein [*Vibrio cholerae* Mex1]
(SEQ ID NO: 395)

MFVLGVDIGYSNLKLAIGQSGSEPKTIILPAGAGPADRMPERIGGGDDETCLYVSVDNER

WAAGVPAGRLQGWERELHPEYPTTKTYKALFHAALLMAETESIDLVVTGLPVSQFHEP

QRKSDLVQRLKGVHQVTPKRSITVHDVRVLPQPAGAYMDLVQTGGDLGLIEEGRVVVI

DPGFFSVDWVALEAGEIRYSSSGTSLQAMSVLLETIDKLISEDHGAKVGMDRLEKAMRT

SDLQVLLFGEKVDISPYLNAAMKKVAPVALTAMRQSMRDESINADLVLIAGGGAMAY

KEAAKEIFSRSKIIVPEQSVLANVRGFWFYGA gi|260102319|ref|ZP_05752556.1|conserved hypothetical protein
[*Lactobacillus helveticus* DSM 20075]
(SEQ ID NO: 396)

MWYSVYTQNNAIQGECFMDIFSLDLGNKQTKLKSSKAEYVLPSRYLNQADMPMSVGN

STMNNDLHTYSVPFSDDKYVWGRDIDRLHLDEYLADTIMYGARYNSEAFKLLANFALG

LLASDFKAAKDQVLEVVVTAGLPTGDYADQGQLKALLKVLEGQHQVTIDDKIVTVRVR

KVYILPQPIGTLYNELLDDEGFIQNKNLLDEKVGIVDVGGGTILIDTILNFELSGKNRHQF

NTGVNDLYEAIANGINGDTSLYQLEKDLRKGNQQHHWSYRFSKNRQDDITDLVCKEID

RFTRRLVANVTSTLKNLNSIDTLFFTGGGANLLNQKILNTTFTNAVIVKNTEVANVNGFY

KYGLSQQAKNEGGK gi|260892708|ref|YP_003238805.1|hypothetical protein Adeg_0813
[*Ammonifex degensii* KC4]
(SEQ ID NO: 397)

MKVAIDVGYGFVKGVAGSGERVRFPSVVAPAQELVLSDLAGREVGHLVELRRLSGAVE

RYFVGELALKEGRAQAVTLDRDKHLHPYHSVLLLAAARLLGAGSSAELCVGLPVAYYR

PRREELKRHLMGLSAEVSVDGSPAARVSFSRVLVYPQGAGALLTAADLPESGLTVTVD

VGFKTTDFVTCEVQDGKALPVSSLCGSLEVGVHTALYLVQAAYQARTGAPLDFTRAER

LLREGRTFFRGEELDFSREAEMARLAAARSIADGVLAVLGSRADEVAVYYLAGGGAEA

LPQLRQMLPGRVRVLPDPTFANALGFLKVLSGSA gi|282898898|ref|ZP_06306882.1|conserved hypothetical protein
[*Cylindrospermopsis raciborskii* CS-505]
(SEQ ID NO: 398)

MTEPTPAANPINLAAVPMNSGISKQTVSSISLTHKPTSSSGKNILSVDLGRTSTKTCVSRE

PGTVAFIPANVKHMSTEQIRSGVFESKTADPIIDLWLEYQGSGYAVGQLAADFGANLGV

GKSKVEDALVKVLAAVGYFKLQGEISVVLGLPFLSLEQFEKEKAQLVSLLTGPHTVKFR

GESLLISITKVWVMPEGYGSLLWTESQPNKSPLVPDLTTISVGIVDIGHQTIDLIMVDNFR

FARGLSQSEDFAMSEFYQRVAGEIEGADSQSLALISAVNKPKGERFYRPKGATKPTNLD

DFLPNLTEQFSREICSRVLAWLPDRVTDVIITGGGEFFWADIQRLLKEARINAYLAAPSR

EANALGQYLYGEAQLSTSRVANQ

-continued gi|282898087|ref|ZP_06306082.1|conserved hypothetical protein
[*Raphidiopsis brookii* D9]
(SEQ ID NO: 399)
MTESTPVANPINLAAVPMNSGISRPTVPSISSAHKPTTTSGKNILSVDLGRTSTKTCITREP

GTVVFIPSNVKHMSAEQIRSGVFESKTADPLMDLWLEYQGSGYAAGQLAADFGADLGV

GKSKVEDALIKVLAAAGYFKLQEEISVVLGLPFLSLEQFEKEKAQLISLLTGQHIVNFRGE

SISVSITKVWVMPEGYGSLLWTESQPNKSPLVPDLTKISVGIVDIGHQTIDLIMVDHFRFA

RGLSQSEDFGMSEFYQRVAGEIEGADSQSLALISAVNKPKGERFYRPKGVTKPTNLDDV

LPNLTEQFSREICSRVLAWLPDRVTDVIITGGGEFFWGDIQRLLKEAKINAYLAAPSRE

ANALGQYLYGEAQLSSSRGVARQ gi|281491857|ref|YP_003353837.1|hypothetical protein LLKF_1403
[*Lactococcus lactis* subsp. *lactis* KF147]
(SEQ ID NO: 400)
MNIFAIDLGNKRIKMKSEKGEYSYPSSYLNAEQVATGGLGSESVEQNFVFKIPQDAKNSF

IWGPNLEVYNLPERMIDTYARSGRMKQKKAIRILEFALGRLAMDYPEAYESPLVVHLTL

GLSITDMHEESDTIDVLKKLAIGQHQILIDGRVLTIIIPTEEFLSIIPQYMGTVLNLAFDEEY

QRNQRFSDGKIGVIDIGGGTILINRSVGLNPSPNGDERFEGIQNLIKEIGRRINSTKPFLIEQ

MLRSADDKGNYNYRPNSNRQDSRDITSVVRGEIERYTRFTVAPLVTENFPDIEEIDFIVVT

GGGASLLAKEALKDEIGEEYFERLFFLNESEFANVRGFYKGGYLKWHISNDDSLQIKNSL

EKVQTSLTNFEAFQDEKELVIPSNETINTLRSQEVLEAQKKLQALESEIEGIKLEFED gi|283846962|ref|ZP_06364418.1|hypothetical protein BcellDRAFT_2920
[*Bacillus cellulosilyticus* DSM 2522]
(SEQ ID NO: 401)
MKEQILIAVDCGKYQTKGIARYRGKTFMVSFRTKMMPVSRLGVDIQPNSFLVEYLGNE

YLIGNMVSEDFVDYSLTKNSTIHQISIYTAISQLLQKANAPANVDIRLAVNVPISTYKDSV

QKDSFKQMVENRRGSIHLLVNGRTHSFELSDVTLAFEGMGEVYSKPDVYKDKNTIVVD

LGGLNTTLCTFSGIQPLVNTMIVSDLGINVLKGRIGKAINERYGLSVSADDLEQVLRSGY

FASKGEVFEESKVFIEELKYDHVQQIIRFARSRGYTFNMSDIHFVGGGAIILKRYIKQEFP

HAVILDNPQYSNCLSFLKILEVKYAKH gi|284051383|ref|ZP_06381593.1|hypothetical protein AplaP_07907
[*Arthrospira platensis* str. Paraca]
(SEQ ID NO: 402)
MQSNKQPGQSQSQSPLAKATTTKPTTTTVVGRSTILSVDLGRTATKSCISRNPADVVFIPS

NVAQLSVEKARGGGFESKNTDPLLDLWLEYQGNGFAVGQLAADFGASLFGVDPAANP

SKVNDALIKIFACVGYFNLKGDLDVVLGLPFYSQEQFEREKEQIMSLLGPNTLVFRGEQ

VVVDIQSVRVMPEGYGSLIWCEAQGSKDMPNFADLSVAIVDVGHQTTDFLTVDRFRFA

RGVSQSEVFAMSKFYEEVAAKIEGADAQSLFLLEAVHKPQGQRFYRPRGATKPANLDEI

VPELRKIFARDLCDRVVKWLPERVTDVVITGGGEFFWQDLQPLLKEAQLRAHLTQPA

RKANSLGQYVYGEAQLAKR gi|288796993|ref|ZP_06402566.1|StbA family protein
[*Desulfurispirillum indicum* S5]
(SEQ ID NO: 403)
MKCIGQDIGFGDVKTVIEDQMLKTPTAIAYEGFGARVDLDGPTSIEFEGQNYLVGEDAIE

SGQPVFETTSIDFLLRYAPLLAYHAIKAAGFDFDEKIHLGVGLPVSYYTPENKAALANRL

NTAVVNKERLQLNTLVYPQGVGAFYDYRLTTNEKISSALIVDIGYNTVDVVHISKGRPN

KSGSGMFDRAGISVIIRELSRFISDRHQIQLSNQVIKEIFISKKLSLYGKEISLEEPIRQIVER

YTTHLLHSLEDGYHQQLAQAQKIVITGGVAHYLQHYIPTKMQESIVIPESPEFANARGFY

KVLIASISDSENVDA gi|288554535|ref|YP_003426470.1|hypothetical protein BpOF4_07600
[*Bacillus pseudofirmus* OF4]
(SEQ ID NO: 404)
MTKSRIAAIDVGNDSVKALFGKADFELNIPNVIARDTEDRPVIGIEELNDKDPLEGIHIRV

HSPALNDNNAIYRVGNLATKSDNATELDPGSSKSEEDQTLVMLFATLALDAVRAENGE

LFKKSNQVIDANYTLGTGLPLREVKEGKDVGYRSQLLSSVHQVEFLVTPKYQGLKVNIR

FDQVKVYPEGFAAYINLVMDKDLNIINRDLVDKRILIQDIGGLSTDIAVIKNRNVDDDKA

QGFNLGVSESLEAIREEIRTKHGVELDTRRDVVEVITKKQDRNHIMVKGSRTSVHDITDR

ILFELAKKQYRHLRNVWQKNSQTEICYFVGGGAMVLKEYLKTLNNNLDGYNIAFFEDE

KESIWMMANAYYKLIADFDRKNNQVAAAKDPQSHQEKKAAKK gi|288557196|ref|YP_003429263.1|hypothetical protein BpOF4_21879
[*Bacillus pseudofirmus* OF4]
(SEQ ID NO: 405)
MIVMNMNVANDNGNNEQAIKVNDVLYRQPNTYAMPERPSFEDNSEPETLIPNLLNELE

VDIQSDSIDFGGLYFIGRKAIKSKYTAHSMSVDSEKKYESDLPIINTLGLLSGVAVQNAY

KESKELPKEISLNVDMATALPVNQWSRETASFFSKRFMEGLHTVIVYVGHLKVRVSMKF

TYVKVIPEGTPVLFNLIEDQEGNYRNDSIFDEFKKEYEVNVDGEYFQDKRIKHVDIGDGT

CDTPLTIGYEYDRDFVNGIPTGIGHSINKAIDLFKKEVSDMNISRQQFIDYVKEEGHPYHD

KAVRLIKQSMRSEVKSIHDHIVDELKKASNEVDIICVYGGGSILMKDHLYKPLKKLCDRP

DIPAKLLWVPEQFAPLMNVEGLNIFLKAVLPQLKEKELASK gi|289176854|emb|CBJ93023.1|conserved hypothetical protein
[*Xenorhabdus nematophila* ATCC 19061]
(SEQ ID NO: 406)
MGNYRGYTGRSQAVFSLQQEENNRKAIKKQSLEDFMNQFVMGLDIGYSNLKMAMGH

KGEEARTVVMPVGAGPLELMPQQLTGGAGTCIQVVIDGEKWVAGVEPDRLQGWEREL

HGDYPSTKPYKALFYAALLMSEQKEIDVLVTGLPVSQYMEAELREALKARLEGEHQITP

KRTVTVKSVVVVPQPAGAYMDIVSSTKDDDLLEIIQGGKTVVIDPGFFSVDWVALEEGE

VRYHSSGTSLKAMSMLLQETNRLIQEDHGGAPGIEKIEKAIRAGKTEIFLYGEKVSIKDYF

KKASAKVAQNALVPMRKSMREDGMDADVVLLAGGGAEAYQDAAKELFPKSRIVLPKE

SVASNARGFWYCG gi|289635834|ref|ZP_06468118.1|conserved hypothetical protein
[*Burkholderia* sp. CCGE1003]
(SEQ ID NO: 407)
MKVSAFGVDIGYGHTKVALRTGSEISTASFPSLAPLVPHLELSRTRERVADGLNVVLIEV

QGSHYAVGPEVESLPACSSLTRTSLDSFCLTPMYTALLGGALYRAGATEIECMVLGLPA

RFSWVYFRYLRDAFTGALDFGQGVIHVGSVDVVPPLLGSLGTFANSGDGRFDPEHGHLL

IDVGYSETSWLLYCDHKIVPQCSGHVRGGAWQVYRTIGSLIANRERCPVDNMERIGRCL

SDKKPLLHYGKDIDLAPLVESSQAVVSAAFEIIRDRTPSPSRLKSIVLTGGGASLYETAIR

AAFPRVRIDILDAPSHANAKGFLLLGEAQLAGRKLVPTSA gi|291279120|ref|YP_003495955.1|hypothetical protein DEFDS_0720
[*Deferribacter desulfuricans* SSM1]
(SEQ ID NO: 408)
MRKVISIDIGFGSTKVAFNEGSGLRLEKFPTAIAPIPSSNHFNDNFYQEDKHFYFEGQLYT

VGDAAKADAIVTTSYEFLHKYSPLILYYIIEKFNIDYSNAVFALGLPLSYYTNDKINEMSN

RLKSFTVNDVEISIDVKILVQGVGCLFDYLSTNQSNVKNGIVVDIGYNTIEFIVIQNGKVK

KADSRGLVKKGMNMLIVKLQQEIQSKYALELTEHEAVSALEDESINLYGNKIPLKEDIIK

LKKWYTDTVIQNLIGMYDDKNKEI

-continued gi|291529699|emb|CBK95285.1|hypothetical protein [Eubacterium rectale M104/1]

(SEQ ID NO: 409)

METSIFATKSEIREHKNPSFGNVHIIGLDMGYSGVKCFHENGNFVFPNYCQKIEGEIFGDL

SRNDLIYEDLKSGDRYYVGALAIKSLSEDSTVAEDKILGRNHYGHMDFLIKFRTALGLA

RWDIPEDEPLFIQTGLPPAYIKTDEMLLRNAIQQSHDFALISCGKRKEFHIDITAEDVDVM

YQPMGTFYSVTTDQFGNLTNDLKTFRNSDLLVFDCGFKTLDKFVIQNKKLEEKDTDENL

GMKRILEETRNSMQEDLKKKGYSVSVSLPAMQQCLKNGVVRINDRINFTVKEFPIEEYL

KKANELICKEAFDSIKDYVFSIKYLIMTGGTGSAWYGYFKDKLKGIHTLKVISGDYNSNL

PAFYANARGYYMYRLTQFKVKR

SEQUENCE LISTING (479 sequences)

SEQ ID NO: 1 - protein, 391 aa, Bacillus subtilis
MNISRMNVDFGNSMYMNLIDGYFFELPTNVVEISKEAAEGKFTSIVEDPADLKDRLLVSTVIDETERYFLVGELAEPEVLGNQHIKKLHNKVESHIPYVTFLAATAYYQALKGKREDNEVTIEYFQTMLPIWLLKKLDKFSEMQKRMASKFLGTHQVKVLTLGLEKELTIKVEDAACRIESEVARWAIKKNFDLEDKDYAEQFKNYDVVFCDLGGGTDDLVLLPAGLKPPKSRDSFVSNTEAPFLAHLEKLRKEKLLEHFDSVRELEKFIYSNIGKTKMERRDGNTGQKFDLTDIIKKSLKEYTEIKIAQAENTFPAPKDKVYKYLYFGGVGEVLEESISVVTEERYGRDISESNHIVAEDARLLNLYGLEVLSRAEQVKKQANEKEAQSI

SEQ ID NO: 2 - protein, 388 aa, Bacillus thuringiensis
MKITMMNKDSGNSLDMNLIDGFYIETPTNVVEISKDEADSHFVATITNPKELLSRLLISTTIPGEDTERFFLVGDEAGKHALANNHVNKLHDKITSPIPYVMFLSAVSFYHAINETRESDDNTVEIEYFQTMLPIWLLKRTAKFSEAQNAMAERFAGEHEVTIHTPGMEKTLKITVEKATCRIEGEIARLAIKKNFELEDREEARQFDNNDTVLVDIGGGTIDLVLSPAGLKSPKNRDSMQPIDKLSYLSHIEKLRKEKFLEKFSDLRSFETFIVNNFQKPKMELVDGNTGQRVDLTDKIRSSLKEFAKFLILKIQDVMPAPADKVYKYVYFGGVAPILETSIHEVIEEMYGAEIAQANHIFLPDSRKLNLYGLEVKSRGEMLQKTEK

SEQ ID NO: 3 - protein, 369 aa, Bacillus megaterium
MRCIDMKISRFNKDCGNSVDMNIIDGYLFDFPTNVVELQKEAADSFFTDAVTAPEEFKKRILLSTTIGDEEKERYFLVGDIAASQQLANNHINRLHNKITSHIPYVTFLAAIAYYNALHAKDQKDTSIEIDYFSTMLPIWLLKKESTFGEAQKAMANRFVGDHTFHIHTPGFERELKVSVEESSCLKEGEIARFALKKDLTLQDREDANEYVECETVMVDIGGGSIDVVILPEGLKAANSRESFQSIEGIPYLAHIDKLRKEKFPELFTDLRAFDQFILDNYNKQKFELKNENTGESIDLTVQIKSSLKEYVEILLAKLNDVAPPPANKLRKYVYCGGVAPTLEVAIMNSMGEKIGEERTEKYHKVPET

SEQ ID NO: 4 - protein, 407 aa, Bacillus thuringiensis
MKIGRKVADFGNSFNNFTVDGYYFELATNVVKVSKKKAEDLLVERILNPEDLLDRLLISTEIDGEESYYVLGQLAEDNQLANSHVNKMHDKIKSPIPYISFLGAIAYYHALNADKEDDEVEIDYMSMMLPIWLLKREEKFSIAHKMMEQRFIGEHKVKVLTPGMERELTITVNSAKCRNESEIARHSLKYKMVAKDKNSNVISIEKRLEAEKFDDFEVVLTDIGGGSTDAVRLGKGLTTPKHRDSFQVIDIEPFLGYIDRFRKEKVLQYFKDLRTLETFIVKNYKDQEYVLIDENTGQEHDFTSEIVEALQEYAKILVAKVLDVFIPSSTNTVLKFIYIGGEAPVLEPYIRLALLEHMNETAAKNNHFFLSDIIKHDEKEIFAPTSRTINLAALELKAIDETKEQLA

SEQ ID NO: 5 - protein, 409 aa, Clostridium acetobutylicum
MNIKRFNADFGNSTGNFLIDGYYFEIPTNIVEISSKKAEGMFVSPITEKNELLDRLMISTGEKENEKFYLVGEFAQGHEIKTHVNQMNDKLTSIIPYANFLGAVAYYAILKNPSEEKEINVEIDNMKMMLPIWILKKASKFSVAQNQMAARFLGEHTVKVLTMGMERIIKIKVNNSVCKIESEVARYAIKYKMVQEDKIIKILPRANLSDKFTKCETVLCDFGGGSIDCVKLGEGLTPPKARDSFKVIDIEPFLGWLETFRKEKVLQYFYSIKQIEKFLINNYKKQKYILEDPNTGKSYDFTSKFTEMLQDYSDKLVPVIFNTFKETDRLLKFVYFGGESPVLKPYIKKTLLKFVTEKVAEENHIFLDDLLENDTSEVFKPTSRTINLTALELLSISEVTKNKSSEKNE

SEQ ID NO: 6 - protein, 388 aa, Bacillus cereus
MKINMMNKDSGNSLDMNLIDGFYIETPTNVVEISKDEADSHFVATITNPKELLSRLLISTTIPGEDTERFFLVGDEAAKHALANNHVNKLHDKITSPIPYVMFLSAISFYHAINEQRESDDNTIEIEYFQTMLPIWLLKRTAKFSEAQNAMAERFAGEHEVTIHTPGMEKTLKITVEKATCRIEGEIARLAIKKNFELEDREEASQFDNNDTVLVDIGGGTIDLVLSPVGLKSPKNRDSMQPIDKLSYLSHIEKLRKEKFLEKFSDLRSFETFIVNNFQKPKMELVDGNTGQRVDLTDKVRSSLKEFAKFLILKIQDVMPAPADKVYKYVYFGGVAPILEASIHEVIEEMYGAEIAQANHIFLPDSRKLNLYGLEVKSRGEMLQKTEK

SEQ ID NO: 7 - protein, 384 aa, Bacillus cereus
MMNKDSGNSLDMNLIDGFYIETPTNVVEISKDEADSHFVATITNPKELLSRLLISTTIPGEDTERFFLVGDEAGKHALANNHVNKLHDKITSPIPYVMFLSAVSFYHAINETRESDDNTVEIEYFQTMLPIWLLKRTAKFSEAQNAMAERFAGEHEVTIHTPGMEKTLKITVEKATCRIEGEIARLAIKKNFELEDREEARQFDNNDTVLVDIGGGTIDLVLSPAGLKSPKNRDSMQPIDKLSYLSHIEKLRKEKFLEKFSDLRSFETFIVNNFQKPKMELVDGNTGQRVDLTEKIRSSLKEFAKFLILKIQDVMPAPADKVYKYVYFGGVAPILETSIHEVIEEMYGAEIAQANHIFLPDSRKLNLYGLEVKSRGEMLQKTEK

SEQ ID NO: 8 - protein, 388 aa, Bacillus cereus
MKITMMNKDSGNSLDMNLIDGFYIETPTNVVEISKDEADSHFVATITNPKELLSRLLISTKIPGEDTERFFLVGDEAAKHALANNHVNKLHDKITSPIPYVMFLSAVSFYHAINEQRESDDNTIEIEYFQTMLPIWLLKRTAKFSEAQNAMAERFAGEHEVTIHTPGMEKTLKITVEKATCRIEGEIARLAIKKNFELEDREEARQFDNNDTVLVDIGGGTIDLVLSPTGLKSPKNRDSMQPIDKLSYLSHIEKLRKEKFLEKFSDLRSFETFIVNNFQKPKMELVDGNTGQRVDLTDKVRSSLKEFAKFLILKIQDVMPAPADKVYKYVYFGGVAPILETSIHEVIEEMYGAEIAQANHIFLPDSRKLNLYGLEVKSRGEMLQKIER

SEQ ID NO: 9 - protein, 373 aa, Bacillus cereus
MNLIDGFYIETPTNVVEISKDEADSHFVATITNPKELLSRLLISTTIPGEDTERFFLVGDEAGKHALANNHVNKLHDKITSPIPYVMFLSAISFYHAINETRESDDNTIEIEYFQTMLPIWLLKRTAKFSEAQNAMAERFAGEHEVTIHTPGMEKTLKITVERATCRIEGEIARLAIKKNFELEDREEARQFDNNDTVLVDIGGGTIDLVLSPAGLKSPKNRDSMQPIDKLSYLSHIEKLRKEKFLEKFSDLRSFETFIVNNFQKPKMELIDGNTGQRVDLTDKIRSSLKEFAKFLILKIQDVMPAPADKVYKYVYFGGVAPILETSIHEVIEEMYGAEIAQANHIFLPDSRKLNLYGLEVKSRGEMLQKTEK

SEQ ID NO: 10 - protein, 407 aa, Bacillus mycoides
MKIGRKVADFGNSFNNFMVDGYYIELATNVVKISKKKAEDLLVDRISRPEDLLDRLLISTEIDGEESFYLVGQLAEDNQLANSHVNKMHDKINSPIPYISFLGAIAYYHALNAEQEDNVVEIENMSMMLPIWLLKREEKFSIAHKKMEERFTGEHKVKVLTPGMERELTITVNSAKCKNESEVARHSLKYKMVSKDKNTSVISIEKRYESERFDDYEVVLTDIGGGSTDAVRLGKGLTTPKHRDSFQVIDVEPFLGYLERFRKEKLIQYFKDLRTLEKFIVNNYKEQKYVLSNENTGEEYDFTTEIVEALKEYARILVAKVLDVFIPSSTNTVLKFIYIGGEAPVLEPYIRLALLDHMSETAAKNNHFFLNDIIQNSEKEVFAPTSRTINLAALELKAIDEMKGQLA

SEQ ID NO: 11 - protein, 407 aa, Bacillus pseudomycoides
MKIGRKVADFGNSFNNFMVDGYYIELATNVVKISKKQAEDLLVDRISRPEDLLDRLLISTEIEGEESFYLVGQLAEDNQLANSHVNKMHDKINSPIPYVSFLGAIAYYHALNAEQEDNEVEIEHMSMMLPIWLLKREEKFSIAHKKMEERFIGEHKVKVLTPGMEKELTIRVNSAKCRNESEVARHSLKYKMVSKDQNTNVISIEKRYESERFDDYEVVLTDIGGGSTDAVRLGKGLTTPKHRDSFQVIDIEPFLGYLERFRKEKLIQYFKDLRTLEKFIVNNYKVQKYVLSNENTGEEYDFTNEIVEALKEYARILVAKILDVFIPSSTNTVLKFIYIGGEAPVLEPYIRLALLNHMSEMAAKNNHFFLNDIIQNSDKEVFAPTSRTINLTALELKVIDEMKGQLA

SEQ ID NO: 12 - protein, 384 aa, Bacillus thuringiensis
MMNKDAGNSLDMNLIDGFYIETPTNVVEISKDEANSHFVATITNPKELLSRLLISTTIPEEDTERFFLVGDEASKHALANNHVNKLHDKTTSPIPYIMFLSAISFYHAINETRESDENTIEIEYFQTMLPIWLLKRTAKFSEAQHAMAARFTGEHEVTIHTPGMEKTLKIIVEKAICRIEGEIARLAIKKNFELEDREEARQFDDNDTVLVDIGGGTIDLVLSPAGLKSPKNRDSMQPIDKLSYLSHIEKLRKEKFLEKFSDLRSFETFIVNNYQKPKMELVDGNTGQRIDLTEKIQSSLKEFARFLILKIQDVIPAPSDKVYKYVYFGGVAPILKTNIHEVIEEMYGAEIAQANHIFLPDSRKLNLYGLEIKSRGEMLQKTKK

SEQ ID NO: 13 - protein, 388 aa, Bacillus thuringiensis
MKINMMNKDSGNSLDMNLIDGFYIETPTNVVEISRDEADSHFVASITNPKELLSRLLISTTIPGEDNERFFLVGDEAAKHALANNHVNKLHDKITSPIPYIMFLSAISFYHAINEQREPDDNTVEIKYFQTMLPIWLLKRTAKFSEAQNAMAERFAGEHEVTIHTPGMGKTLKITVEKATCRIEGEIARLAIKKNFELEDREEARQFDNNDTVLVDIGGGTIDLVLSPAGLKSPKNRDSMQSIDKLSYLSHIEKLRKEKFLEKFSDLRSFETFIVNNFQKPKMELIDGNTGQRIDLTDKLRSSLKEFAKFLILKIQDVMPAPADKIYKYVYFGGVAPILETSIHEVIEEMYGTEIAQANHIFLPDSRKLNLYGLEVKSRGEILQKTEN

SEQ ID NO: 14 - protein, 384 aa, Bacillus thuringiensis
MMNKDSGNSLDMNLIDGFYIETPTNVVEISKDEADSHFVATITNPKELLSRLLISTTIPGEDTERFFLVGDEAGKHALANNHVNKLHDKITSPIPYVMFLSAVSFYHAINETRESDDNTVEIEYFQTMLPIWLLKRTAKFSEAQNAMAERFAGEHEVTIHTPGMEKTLKITVEKATCRIEGEIARLAIKKNFELEDREEARQFDNNDTVLVDIGGGTIDLVLSPAGLKSPKNRDSMQPIDKLSYLSHIEKLRKEKFLEKFSDLRSFETFIVNNFQKPKMELVDGNTGQRVDLTDKIRSSLKEFAKFLILKIQDVMPAPADKVYKYVYFGGVAPILETSIHEVIEEMYGAEIAQANHIFLPDSRKLNLYGLEVKSRGEMLQKTEK

SEQ ID NO: 15 - protein, 360 aa, Magnetospirillum gryphiswaldense
MWIDLLARERSDKMSEGEGQAKNRLFLGIDLGTSHTAVMTSRGKKFLLKSVVGYPKDVIGLKLLGRPYVVGDEAFEMRSYLDLRYPLQDGVLSEISDRDIEVARHLLTHVVKSAEPGANDEICAVIGVPARASGANKALLLKMAQEVVHTALVVSEPFMVGYGLDKLNNTIIVDIGAGTTDICALKGTVPGPEDQVTLTKAGNYLDERLQNAILERHPELQMNTNVACAVKEQFSFVGARGEAATFEFRAAGKPVRCDVTESVKIACEALMPDIIESIEILLRSFQPEYQATVLQNIVFAGGGSRIRGLAAYVKDKLRPFGNADVTCVKDPTFDGCRGALRLAEELPPQYWCQLGDVSGQ

SEQ ID NO: 16 - protein, 347 aa, Magnetospirillum magneticum
MSEGEGQAKNRLFLGIDLGTSHTAVMSSRGKKFLLKSVVGYPKDVIGLKLLGRPYVVGDEAFEMRSYLDIRYPLQDGVLSEISDRDIEVARHLLTHVVKSAEPGPNDEICAVIGVPARASAANKALLLKMAQEVVHTALVVSEPFMVGYGLDKLINTIIVDIGAGTTDICALKGTVPGPEDQVTLTKAGNYVDERLQNAILERHPELQMNVNVACAVKEQFSFVGTPTEVASFEFRAAGKPVRADVTEPVKIACEALMPDIIESIETLLRSFQPEYQATVLQNIVFAGGGSRIRGLAAYVKEKLRPFGDANVTCVKDPTFDGCRGALRLAEELPPQYWRQLGDVSGS

SEQ ID NO: 17 - protein, 322 aa, Magnetospirillum magnetotacticum
MSSRGKKFLLKSVVGYPKDVIGLKLLGRPYVVGDEAFEMRSYLDIRYPLQDGVLSEISDRDIEVARHLLTHVVKSAEPGPNDEICAVIGVPARASAANKALLLKMAQEVVHTALVVSEPFMVGYGLDKLINTIIVDIGAGTTDICALKGTVPGPEDQVTLTKAGNYVDERLQNAILERHPELQMNVNVACAVKEQFSFVGTPTEVASFEFRAAGKPVRADVTEPVKIACEALMPDIIESIETLLRSFQPEYQATVLQNIVFAGGGSRIRGLAAYVKEKLRPFGDANVTCVKDPTFDGCRGALRLAEELPPQYWRQLGDVSGS

SEQ ID NO: 18 - protein, 346 aa, Magnetococcus sp.
MQSPAGNDKQLFVGIDLGTSRTAIMTRRGVKTMVRSVVGYPKDIIGVKILNNTVVIGQEALDNQAYLNLYYPLADGVLKETSEKDEMAAKELLKYVISQAKPQGDEQILGIVGVPARTSIYNKSQLLKITDDLMSMSMVVSEPFMVAYGLDKLNNAIIIDIGAGTIDICAMKGTVPSDKDQITLLKGGNYVDEVFTHAIAESYPDVQITSYIAQKIKEKHGFVGEPTEEVVVNLRAGGKPMLHDVTRELRFACETIIPDILESVEKLVLSFDPDNQQEALKNIILAGGGSNLIGLDTVLTEGLKEYGKVNVSRVADPDFAGAAGALKLATELPTEYWNQVGDIVGG

SEQ ID NO: 19 - protein, 385 aa, delta proteobacterium
MALADDEQVNDEINETASAIDDNPAPATDQPEFPAEVERPTPAGGGEQVTVGIDLGTCRTVVITDHGQEFEIRSVVGYPKDVISRQAVGDGPIFGAEALDKRNFLELCSPLAEGVVREASERDYRAARELIHHLIDLVRAGNPGVRVNGVIGVPARASLMNKEVLLGVAREVMDRALVVSEPFMVAYALGRLNRAIIVDIGAGTVDICGVKGSLPAAEDQVTTFKGGDYLDERLEAAIIRRHPGAQVTHSLACRLKEEHAFVGEPEKPVEVTLRVEGKPVQFDITDEMRTICESMVPNIIEQLEVLIASFDPEDQEEVLRHIYLAGGGSRIRGLDAMIARGLREYGEVRVTRVDDPERIGAIGALKLAREIPTNQWAQVGLMFGG

SEQ ID NO: 20 - protein, 390 aa, delta proteobacterium
MSETEAEDRPLLLGIDLGVARTAVVSNRGARHLLDSVVGYPRDIIALKTLGAPQIFGARALEHKAALTLYHPLGDGTIAQDRRRDYNAAGELLRHVIELATNSAPPRANVTDHGVHGVSGHGGPQAAASETAMRTSVPEPARSPLSAVPRDRLRVSGVIAVPATFGAGGRQTLATIAGELLADFLIIEQPLPVAYYLGRLDNSLLIDIGAGSISLCPCRGRLPNPNERVTLPKGGDSLDQRLQALISQRYPEVQITRELARQIKEEHAHVGTSPRPVLVTLRAAGKPRQYELSEELRLVCQGLVPEIAEKLAAIIHEFDPEDLDEVLQNIYLTGGGAQIHGLDTALADALADYGQVRIKILDDPEYAGALGALRLAEELPPQRWHDSGFT

SEQ ID NO: 21 - protein, 385 aa, delta proteobacterium
MSETEAEDRPLLLGIDLGVARTAVVSNRGARHLLDSVVGYPRDIIALKTLGAPQIFGARALEHKAALTLYHPLGDGTIAQDRRRDYNAAGELLRHVIELATNSAPPRANVTDHGVHGGPQVAASESAMRTSVPEPARSPLSAVPRDRLRVSGVIAVPATFGAGGRQTLATIAGELLADFLIIEQPLPVAYYLGRLDNSLLIDIGAGSISLCPCRGRLPNPNERVILPKGGDSLDQRLQALISQRYPEVQITRELARQIKEEHAHVGTSPRPVLVTLRAAGKPRQYELSEELRLVCQGLVPEIAEKLAAIIHEFDPEDLDEVLQNIYLTGGGAHIHGLDTALADALADYGQVRIKILDDPEYAGALGALRLAEELPPQRWHDSGFT

SEQ ID NO: 22 - protein, 226 aa, delta proteobacterium
MNKEVLLGVAREVMDRALVVSEPFMVAYALGRLNRAIIVDIGAGTVDICGVKGSLPAAEDQVTTFKGGDYLDERLEAAIIRRHPGAQVTHSLACRLKEEHAFVGEPEKPVEVTLRVEGKPVQFDITDEMRTICESMVPNIIEQLEVLIASFDPEDQEEVLRHIYLAGGGSRIRGLDAMIARGLREYGEVRVTRVDDPERIGAIGALKLAREIPTNQWAQVGLMFGG

SEQ ID NO: 23 - protein, 330 aa, Bacillus phage 0305phi8-36
MYIFGCDIGFKQFKGINLEDDIEFKFPNIIGFPTSLEIQNATDHGETMKDLWLTYDDETYYVGDKASEFATNHRYTFLANKVDTIDETVKLLTGLGLLYETGQNKIDLMVTGVPVEEYFLVKDKIETEFVRDYDYSFRGRKCRSTIQKVVVVPQGAGDYYDYILDESGQVITERVKPKTVIVNIGYRTTEIVTMNNGRFSRSESTTLYTATNNFHKELRRLLAKEYGIRKNLTQIDEIYRERKVYIKGIATDISELITSAIDMHVGSISGEIPVWVNPDDVHEILLTGGGSTGLTPFFQSQFGDIILKHDNPEFGNARGFAKYGRLIAHG

SEQ ID NO: 24 - protein, 359 aa, Proteus vulgaris
MELLRKGRSFGGLFLIKGKVMNQSERFIVGLDIGYSNVKVACGGTQLLDPKVTIFPAYATPEPESDLALAKKSPDEVKVYPNGTEWRVFTNRVGHRELHESYHSTEMYKALFYGALIKATEGRSDVIDILVTGLPVRIANSEADRSQLCESFTGKHEVTPGRFILVKEVVVLSQGVGIMNDILNTEGLISDEDLEFSNILVIDPGYYSMDYVTFHRGDKKNEFSGSSLNATSVIIEEIVRVLERDYPKEGAQETERIETALRLGNKTFNNGFRSVEIEPLIEEVSHRIVSSVVAELLKRTRSIGPVHIIISAGGGARFYDHFIKEAFPQARILQSVNPVASNSIGYWHYGVNKLSSQSD

SEQ ID NO: 25 - protein, 364 aa, Pseudomonas resinovorans
MQLQRLGFCRCGVSCVAGSSASSFGALLLSFFAGSGIRMGNALGLDIGYSNVIGVFGSGDGQPESIIRPSQAAPLSVLPGDSGLRPGEVIVEVDGAPWVAFAAPGRVQDGRELHEDYTSSHAYEALFKGALLHAAGDKDVIDCLVTGLPVSQARDKPYVEALIKRMTGTHRITPKREVTVKRVEVVAQPIGTLTEIYCNSDASEVIEESVSIIIDPGFFSVDWVVFDHRELVVNSSSSSLKAMSVVLEACNEEIAKDHGGIPGVEKIEHALQSGKSYILIYGRKVELAEYLERAAERVIPSVFTEIKQGLRFLKGRAIDCVILGGGGASLYEPFARKEFPDALVVKPVNSVKSNAEGFWHIARS

SEQ ID NO: 26 - protein, 327 aa, Yersinia ruckeri
MSQFVLGLDIGYSNLKMAMGHKGEEARTVVMPVGAGPLELMPQQLTGGAGASIQVVIDGEKWVAGVEPDRLQGWERELHGDYPSTNPYKALFYAALLMSEQKEIDVLVTGLPVSQYMEVERREALKARLEGEHQITPKRSVAVKSVVVVPQPAGAYMDVVSSTKDEDLLEIIQGGKTVVIDPGFFSVDWVALEEGEVRYHSSGTSLKAMSVLLQETDRLIQEDHGGAPGIEKIEKAIRAGKAEIFLYGEKVSIKDYFKKASTKVAQNALIPMRKSMREDGMDADVVLLAGGGAEAYQDAAKELFPKSRIVLPNESVASNARGFWFCG

SEQ ID NO: 27 - protein, 327 aa, Photobacterium damselae
MSQFVLGLDIGYSNLKMAMGYKGEEARTVVMPVGAGPLELMPQQLTGGAGTCIQVVIDGEKWVAGVEPDRLQGWERELHGDYPSTNPYKALFYAALLMSEQKEIDVLVTGLPVSQYMDVERREALKSRLEGEHQITPKRSVAVKSVVVVPQPAGAYMDVVSSTKDEDLLEIIQGGKTVVIDPGFFSVDWVALEEGEVRYHSSGTSLKAMSVLLQETDRLIQEDHGGAPGIEKIEKAIRAGKAEIFLYGEKVSIKDYFKKASTKVAQNALIPMRKSMREDGMDADVVLLAGGGAEAYQDAAKELFPKSRIVLPNESVASNARGFWFCG

SEQ ID NO: 28 - protein, 324 aa, Shewanella sp.
MFVLGVDIGYSNLKLAIGQSGSEPKTIILPAGAGPADRMPERIGGGDDETCLYVSVDNERWAAGVPAGRLQGWERELHPEYPTTKTYKALFHAALLMAETESIDLVVTGLPVSQFHEPQRKSDLVQRLKGVHQVTPKRSITVHDVKVLPQPAGAYMDLVQTGGDLGLIEEGRVVVIDPGFFSVDWVALEAGEIRYSSSGTSLQAMSVLLETIDKLISEDHGAKVGMDRLEKAMRTGDLQVLLFGEKVDISPYLNAATKKVAPIALTAMRQSMRDESINADLVLIAGGGALAYKEAAKEIFSRSKIIVPEQSVLANVRGFWFYGA

SEQ ID NO: 29 - protein, 324 aa, Vibrio cholerae
MFVLGVDIGYSNLKLAIGQSGSEPKTIILPAGAGPADRMPERIGGGDDETCLYVSVDNERWAAGVPAGRLQGWERELHPEYPTTKTYKALFHAALLMAETESIDLVVTGLPVSQFHEPQRKSDLVQRLKGVHQVTPKRSITVHDVKVLPQPAGAYMDLVQTGGDLGLIEEGRVVVIDPGFFSVDWVALEAGEIRYSSSGTSLQAMSVLLETIDKLISEDHGAKVGMDRLEKAMRTGDLQVLLFGEKVDISPYLNAAMKKVAPVALTAMRQSMRDESINADLVLIAGGGAMAYKEAAKEIFSRSKIIVPEQSVLANVRGFWFYGA

SEQ ID NO: 30 - protein, 324 aa, Vibrio cholerae
MFVLGVDIGYSNLKLAIGQSGSEPKTIILPAGAGPADRMPERIGGGDDETCLYVSVDNERWAAGVPAGRLQGWERELHPEYPTTKTYKALFHAALLMAETESIDLVVTGLPVSQFHEPQRKSDLVQRLKGVHQVTPKRSITVHDVKVLPQPAGAYMDLVQTGGDLGLIEEGRVVVIDPGFFSVDWVALEAGEIRYSSSGTSLQAMSVLLETIDKLISEDHGAKVGMDRLEKAMRTGDLQVLLFGEKVDISPYLNAAMKKVAPVALTAMRQSMRDESINADLVLIAGGGALAYKEAAKEIFSRSKIIVPEQSVLANVRGFWFYGA

SEQ ID NO: 31 - protein, 324 aa, Vibrio cholerae
MFVLGVDIGYSNLKLAIGQSGSEPKTIILPAGAGPADRMPERIGGGDDETCLYVSVDNERWAAGVPAGRLQGWERELHPEYPTTKTYKALFHAALLMAETESIDLVVTGLPVSQFHEPQRKSDLVKRLKGVHQVTPKRSITVHDVKVLPQPAGAYMDLVQTGGDLGLIEEGRVVVIDPGFFSVDWVALEAGEIRYSSSGTSLQAMSVLLETIDKLISEDHGAKVGMDRLEKAMRTGDLQVLLFGEKVDISPYLNAAMKKVAPVALTAMRQSMRDESINADLVLIAGGGAMAYKEAAKEIFSRSKIIVPEQSVLANVRGFWFYGA

SEQ ID NO: 32 - protein, 324 aa, Vibrio cholerae
MFVLGVDIGYSNLKLAIGQSGSEPKTIILPAGAGPADRMPERIGGGDDETCLYVSVDNERWAAGVPAGRLQGWERELHPEYPTTKTYKALFHAALLMAETESIDLVVTGLPVSQFHEPQRKSDLVKRLKGVHQVTPKRSITVHDVKVLPQPAGAYMDLVQTGRDLGLIEEGRVVVIDPGFFSVDWVALEAGEIRYSSSGTSLQAMSVLLETIDKLISEDHGAKVGMDRLEKAMRTGDLQVLLFGEKVDISPYLNAAMKKVAPVALTAMRQSMRDESINTDLVLIAGGGALAYKEAAKEIFSRSKIIVPEQSVLANVRGFWFYGA

SEQ ID NO: 33 - protein, 315 aa, Aeromonas salmonicida
MKQFILGLDIGYSNLKIAMGFKGGHVTTTVLPVGAGPLALMPQQLTGGEGNCIQIVIDDEKWVAGVEPDRLQGWNRELHDDYPATKPYKALFYAALLLSEQKEIDVLVTGLPVSQFMNPELREALKKRLEGEHQITLKRSVTVKSVVVVPQPAGAYMDIVSSTKDEGLLEVLREGKTVVIDPGFFSVDWVALEEGEVRYHSSGTSLKAMSVLLKTINLLIQEEHGGSPGIDKIEKAIRSGKNEILLFGQKVGLKEYLDRESFNVAQNALIQMRTSMREDGMDADVVLLAGGGAEAYKAAAKARIQLRSATLAYAA

SEQ ID NO: 34 - protein, 341 aa, Bacillus cereus
MKSLYAIDVGIGFTKRAYRQDVDSEVTIKSEASTLAPIPNHAESEDLTKVSFIDLDFAYYMGNEAHQSDASFLPPFDEEIENYYESEQFKQQIFGCIAKDYKENVVLPLVVTGLPVTDFGSQHEQLQRALKKETSVQIDGKFITITVENVLILQQPVALHAYFLKEGIIQEQDRILIIDGGFRTLEMTDMKQNVILNHYETELGCSKPLKNIKNILQNHAGESNQLHINDMPNILEKGYGGREENPQTSQVHTLIQKELDAHFQDVMRVLQEQFKLEQYDTIIWTGGIVDLHKKRIEKIQGEISSFRMVDASKEAALHGYYMIGSQVFDDITNQSVYESKL

SEQ ID NO: 35 - protein, 341 aa, Bacillus cereus
MKSLYAIDVGIGFTKRAYRQDVDSEVTIKSEASTLAPVPNHDESEDLTKVSFIDLDFAYYMGNEAHQSDASLLPPFDEEIENYYESERFKQQIFGCIAKDYKENVVLPLVVTGLPVTCFGSQHEQLQRALKKETSVQIDGKFITITVENALILQQPVALHAYFLKEGIIQERDRILIIDGGFRTLEMTDMKQNVILNHYETELGCSKPLKNIKNIVQNHAGESNQLHINDMPNILEKGYGGREEDPQTSQVHTLIQKELDAHFQDVMRVLQEQFKLDQYDTIIWTGGIVDLHKKRIEKIQGEISSFRMVDASKEAALHGYYMIGSQVFDDITNQSVYESKL

SEQ ID NO: 36 - protein, 340 aa, Bacillus thuringiensis
KSLYAIDVGIGFTKRAYRQDEDSEVTVKSEASTLAPVPNHDESEDLTKVSFIDLDFAYYMGNEAHQSDASFLPPFEEEIENYYESEQFKQQIFGCIAKDYKENVVLPLVVTGLPVTYFGSQHEQLQRALKKETSVQIDGKFIHITVENALILQQPVALHAYFLKEGIIQERDRILIIDGGFRTLEMTDMKQNVILNHYETELGCSKPLKNIKNILQNHAGESNQLHINDMPNILEKGYGGREENPQASQVHTLIQKELDTHFQDVMCVLQEQFKLDQYDTIIWTGGIVDLHKKRIEKMQGEISSFRMVDASKEAALHGYYMIGSQVFDDITNQSVYESKL

SEQ ID NO: 37 - protein, 341 aa, Bacillus cereus
MKSLYAIDVGIGFTKRAYRQDVDSEVTIKSEASTLAPVPNHAESEDLTKVSFIDLDFAYYMGNEAHQSDASFLPPFDEEIENYYESEQFKQQIFGCIAKDYKENVVLPLVVTGLPVTYFGSQHEQLQRALKKETSVQIDGKFINITVENALILQQPVALHAYFLKEGIIQERDRILIIDGGFRTLEMTDMKQNVILNHYETELGCSKPLKNIKNIVQNHAGESDHLHINDMPNILEKGYGDREENPQTSQVHTLIQKELDTHFQDVIRVLQEQFKLDQYDTIIWTGGIVDLHKKRIEKMQDEISSFRIVDASKEAALHGYYMIGSQVFDDITNQSAYESKL

SEQ ID NO: 38 - protein, 341 aa, Bacillus cereus
MKSLYAIDVGIGFTKRAYRQDEDSEVTVKSEASTLAPVPNHDESEDLTKVSFIDLDFAYYMGNEAHQSDASFLPPFEEEIENYYESEQFKQQIFGCIAKDYKENVVLPLVVTGLPVTYFGSQHEQLQRALKKETSVQIDGKFIHITVENALILQQPVALHAYFLKEGIIQERDRILIIDGGFRTLEMTDMKQNVILNHYETELGCSKPLKNIKNIVQNHAGESSHLHINDMPNILEKGYGGREEDPQTSQVDTLIQKELDAHFQDVMRVLQEQFKLDQYDTIIWTGGIVDLHKKRIEKMQGEISSFRMVDASKEAALHGYYMIGSQVFDDITNQSVYESKL

SEQ ID NO: 39 - protein, 341 aa, Bacillus thuringiensis
MKSLYAIDVGIGFTKRAYRQDEDSEVTVKSEASTLAPVPNHDESEDLTKVSFIDLDFAYYMGNEAHQSDASFLPPFEEEIENYYESEQFKQQIFGCIAKDYKENVVLPLVVTGLPVTYFGSQHEQLQRALKKETSVQIDGKFIHITVENALILQQPVALHAYFLKEGIIQERDRILIIDGGFRTVEMTDMKQNVILNHYETELGCSKPLKNIKNILQNHAGESNQLHINDMPNILEKGYGGREENPQASQVDTLIQKELDTHFQDVMCVLQEQFKLDQYDTIIWTGGIVDLHKKRIEKMQGEISSFRMVDASKEAALHGYYMIGSQVFDDITNQSVYESKL

SEQ ID NO: 40 - protein, 341 aa, Bacillus cereus
MKSLYAIDVGIGFTKRAYRQDEDSEVTVKSEASTLAPVPNHDESEDLTKVSFIDLDFAYYMGNEAHQSDASFLPPFEEEIENYYESEQFKQQIFGCIAKDYKENVVLPLVVTGLPVTYFGSQHEQLQRALKKETSVQIDGKFIHITVENALILQQPVALHAYFLKEGIIQERDRILIIDGGFRTLEMTDMKQNVILNHYETELGCSKPLKNIKNILQNHAGESNQLHINDMPNILEKGYGGREENPQASQVDTLIQKELDTHFQDVMCVLQEQFMLDQYDTIIWTGGIVDLHKKRIEKMQGEISSFRMVDASKEAALHGYYMIGSQVFDDITNQSVYESKL

SEQ ID NO: 41 - protein, 341 aa, Bacillus anthracis
MKSLYAIDVGIGFTKRVYRQDEDSEVTVKSEASTLAPVPNHDESEDLTKVSFIDLDFAYYMGNEAHQSDASFLPPFEEEIENYYESEQFKQQIFGCIAKDYKENVVLPLVVTGLPVTYFGSQHEQLQRALKKETSVQIDGKFIHITVENALILQQPVALHAYFLKEGIIQERDRILIIDGGFRTLEMTDMKQNVILNHYETELGCSKPLKNIKNIVQNHAGESDHLHINDMPNILEKGYGGREEDPQTNQVHILIQKELDAHFQDVMRVLQEQFKLDQYDTIIWTGGIVDLHKKRIEKMQGEISSFRMVDASKEAALHGYYMIGSQVFDDITNQSVYESKL

SEQ ID NO: 42 - protein, 341 aa, Bacillus cereus
MKSLYAIDVGIGFTKRAYRQDVDSEVTIKSEAATLAPVPNHAESEDLTKVSFIDLDFAYYMGNEAHQSDASFLPPFEEEIENYYESERFKQQIFGCIAKDYKENVVLPLVVTGLPVTCFGSQHEQLQRALKKETSVQIDGKFIHITVENALILQQPIALHAYFLKEGIIQERDRILIIDGGFRTLEMTDMKQNVILNHYETELGCSKPLKNIKNIVQNHEGESNQLHINDMPNILEKGYECREENHETSQVHTLIQKELDAHFQDVMRVLQEQFKLEQYNTIIWTGGIVDLHKKRIEKMQSEISSFRMVDASKEAALHGYYIIGSQVFDDITNQSAYESKL

SEQ ID NO: 43 - protein, 341 aa, Bacillus cereus
MKSLYAIDVGIGFTKRAYRQDVDSEMTIKSEASTLAPVPNHAESEDLTKVSFIDLDFAYYMGNEAHQSDASFLPPFDEEIENYYESERFKQQIFGCIAKDYKENVVLPLVVTGLPVTCFGSQHEQLQRALKKETSVQIDGKFIHITVENALILQQPVALHAYFLKEGIIQERDRILIIDGGFRTVEMTDMKQNVILNHYEAELGCSKPLKNIKNIVQNHEGESNQLHINDMPNILEKGYECREENHETSQVHTLIQKELDAHFQDVMRVLQEQFKLEQYNTIIWTGGIVDLHKKRIEKMQSEISSFRMVDASKEAALHGYYIIGSQVFEDITNQSAYESKL

SEQ ID NO: 44 - protein, 341 aa, Bacillus weihenstephanensis
MKSLYAIDAGIGFTKRAYRQDVDSEMTIKSEASTLAPVPNHAESEDLTKVSFIDLDFAYYMGNEAHQSDASFLPPFDEEIENYYESERFKQQIFGCIAKDYKENVVLPLVVTGLPVTCFGSQHEQLQNVLKKETSVQIDGKFINITVENALILQQPVALHAYFLKEGIIQERDRILIIDGGFRTLEMTDMKQNVILNHYETELGCSKPLKNIKNILQNHAGESNHLHINDIPKILEKGYGGREKNYQTSQVNTLIQKELDAHFQDVMRVLQEQFKLDQYDTIIWTGGIVDIHKKRIEKMQGEISSFRMVDASKEAALHGYYIIGSQVFEDITNQSAYESKL

SEQ ID NO: 45 - protein, 341 aa, Bacillus cereus
MKSLYAIDVGIGFTKRAYRQDVDSEMTVKSEASTLAPVPNHAESEDLTKVSFIDLDFAYYMGNEAHQSDASFLPPFDEEIENYYESERFKQQIFGCIAKDYKENVVLPLVVTGLPISCFGSQHEQLQRALKKETSVQIDGKFIHIMVENALILQQPVALHAYFLKEGIIQERDRILIIDGGFRTLEMTDMKQNLILNHYETELGCSKPLKNIKNIVQNHEGESNQLHINDMPNILEKGYECREENHETSQVHTLIQKELDAHFQDVMRVLQEQFKLEQYNTIIWTGGIVDLHKKRIEKMQSEISSFRMVDASKEAALHGYYIIGSQVFDDITNQSAYESKL

SEQ ID NO: 46 - protein, 341 aa, Bacillus cereus
MKSLYAIDVGIGFTKRAYRQDEDSEVTVKSEASTLAPVPNHDESEDLTKVSFIDLDFAYYMGNEAHQSDASFLPPFEEEIENYYESEQFKQQIFGCIAKDYKENVVLPLVVTGLPVTYFGSQHEQLQRALKKETSVQIDGKFIHITVENALILQQPVALHAYFLKEGIIQERDRILIIDGGFRILEMTDMKQNVILNHYETELGCNKPLKNIKNIVQNHAGESNQLHINDMPNILEKGYGGREENPQASQIDTLIQKELDTHFQDVMCVLQEQFMLDQYDTIIWTGGIVDLHKKRIKKMQGEISSFRMVDASKEAALHGYYMIGSQVFDDITNQSVYESKL

SEQ ID NO: 47 - protein, 341 aa, Bacillus cereus
MKSLYAIDVGIGFTKRAYRQDEDSEVTVKSEASTLAPVPNHDESEDLTKVSFIDLDFAYYMGNEADQSDASFLPPFEEEIENYYESEQFKQQIFGCIAKDYKENVVLPLVVTGLPVTYFGSQHEQLQRALKKETSVQIDGKFIHITVENALILQQPVALHAYFLKEGIIQERDRILIIDGGFRTLEMTNMKQNVILNHYETELGCNKPLKNIKNIVQNHAGESNQLHINDMPNILEKGYGGREENPQASQIDTLIQKELDTHFQDVMCVLQEQFMLDQYDTIIWTGGIVDLHKKRIKKMQGEISSFRMVDASKEAALHGYYMIGSQVFDDITNQSVYESKL

SEQ ID NO: 48 - protein, 341 aa, Bacillus cereus
MKSLYAIDVGIGFTKRAYRQDVDSEMTIKSEASTLAPVPNHTDSEDLTKVSFIDLDFAYYMGNEAHQSDASLLPPFNEEIENYYESERFKQQIFGCIAKDYKENVVLPLVVTGLPVTCFGSQHEQLQHALKKETSVQIDGKFINITVENALILQQPVALHAYFLKEGIIQEQDRILIIDGGFRTLEMADMKQNLILNHYETELGCSKPLKNIKNILQNHAGESNQLHINDMPKILEKGYGDRDENYETSQVDILIQKELDAHFQDVMRVLQEQFKLDQYDTIIWTGGIVDIHKKRIEKMQGEIASFRMVDASKEAALHGYYIIGSQVFEDITNQSAYESKL

SEQ ID NO: 49 - protein, 341 aa, Bacillus thuringiensis
MKSLYAIDVGIGFTKRAYRQDVDSEMTIKSEASTLAPVPNHTDSEDLTKVSFIDLDFAYYMGNEAHQSDASLLPPFNEEIENYYESERFKQQIFGCIAKDYKENVVLPLVVTGLPVTCFGSQHEQLQHALKKETSVQIDGKFINITVENALILQQPVALHAYFLKEGIIQEQDRILIIDGGFRTLEMADMKQNLILNHYETELGCSKPLKNIKNILQNHAGESNQLHINDMPKILEKGYGDRDENYETSQVDILIQKELDAHFQDVMRVLQEQFKLDQYDTIIWTGGIVDIHKKRIEKMQGEIASFRMVDASKEAALHGYYIIGSQVFEDITNQSAQKSQL

SEQ ID NO: 50 - protein, 275 aa, Bacillus anthracis
MKSLYAIDVGIGFTKRVYRQDEDSEVTVKSEASTLAPVPNHDESEDLTKVSFIDLDFAYYMGNEAHQSDASFLPPFEEEIENYYESEQFKQQIFGCIAKDYKENVVLPLVVTGLPVTYFGSQHEQLQRALKKETSVQIDGKFIHITVENALILQQPVALHAYFLKEGIIQERDRILIIDGGFRTLEMTDMKQNVILNHYETELGCSKPLKNIKNIVQNHAGESDHLHINDMPNILEKGYGGREEDPQTNQVHILIQKERMHTSKTLCVYYKNNLS

SEQ ID NO: 51 - protein, 343 aa, Bacillus cereus
MLLGNPYAIDLGNGFTKRASKKNKSLEADVITELSVLAPVDDYYNEASFTKIELTNTDFPYYIGEEARKSKLPLIRALGENKAKRYEDPTFKKQLFGFIAKDFKKNVTIPLLVTGLPVSHFGNQRESIQKVAMEETAVKVNGELITIKVKQCLVIPQPVGTQYYLVKKEIINKEDRILIIDGGFGTFDVTDMSGNAVIDRLGTELGCEKAFMSIEQIVRDNIGETPDLSVSNMHYILENGYKYNGSLYDLYTHKDVAEQVDAELQRHFDAALREVSQKFNLAVYDKIVWTGGMAALHKKRIEKKKEQFPTFAVLENGQEANLLGYYYLGCDVFDKLTKEKASN

SEQ ID NO: 52 - protein, 298 aa, Bacillus cereus
MSGGKMKLKTYKVEGTEYVWGDDIIKVNNTLNTYAQQNRYKTNQYKTLSKIALAEMAAKTNVKSYDEILVITGVPSEEIGTKAVDEIKEVYQGAHDLEVNGKKVSINVVDVIVLAQPVGTVMSRYLDEDGFVADDTYEDMTVGIIDIGTGTTDLDVISMLRREKESTSVPKGMHDVYEPIVAKIKKETSATINDYKLEKVFEEGAYQASKRMDPIDFNDEKTASIKEVYDFIVNGVNNAWKTFDRFDEVLVSDGGANTFHELLEEWIGKVTKLEESQTANVEGFYRYGKFEVGEEDGE

SEQ ID NO: 53 - protein, 346 aa, Staphylococcus aureus
MSNVYVMALDFGNGFVKGKINDEKFVIPSRIGRKTNENNQLKGFVDNKLDVSEFIINGNNDEVLLFGNDLDKTTNTGKDTASTNDRYDIKSFKDLVECSIGLLAREVPEEVVNVVIATGMPSNEIGTDKQAKFEKLLNKSRLIEIDGIAKTINVKGVKIVAQPMGTLLDLNMENGKVFKAFTEGKYSVLDFGSGTTIIDTYQNMKRVEEESFVINKGTIDFYKRIASHVSKKSEGASITPRMIEKGLEYKQCKLNQKTVIDFKDEFYKEQDSLIEEVMSNFEITVGNINSIDRIIVTGGGANIHFDSLSHYYSDVFEKADDSQFSNVRGYEKLGELLKNKVEQESK

SEQ ID NO: 54 - protein, 376 aa, Natranaerobius thermophilus
MVWGSIPDKDRKRRRFSDGISEEDEVISEEEEHHLGGDDAFDRSVKNVGIDLGYGYVKFIDGKEPKMFPSVVGYGNSQKYKSALQLDLNPLDDLQIKIGDEHFFIGDLAIRQSEVASRSLGKDRSQDKNARVLMLTALSLLSSWDKQGFNLVTGLPTNFYAAFAEEWESTLNGEFKTKMKIGGKTQERSFQIEEVTTLPQPFGTLYDQVLNSVGKVVDRDLTDSKIGIVDIGFKTTDLAVSDGMEFINPLSFSTTTGLSNVNRLVNEKLRHEFKIDREEHQLDDCINSQKIMVAGKSEDISSWVREALQTVSDKISVEIESKWDYRDFDTLLLTGGGGEMLYPYLKDKFPNLVLVEDPQTANVRGYQKLANNLFNA

SEQ ID NO: 55 - protein, 351 aa, Symbiobacterium thermophilum
MERLIGVDLGYGFVKATDGREGYLFPSVVGDGSPYLPLRLASQETDPTDNLRVQIGDRVYHVGTLAVRQSRMAYGFLSVMRDEGNDLLVLFLTALSLFASEANTTFSVVTGLPPGRMHLADQFVRSVRGDHRVVRYRTGNPEELYLRVDRVTVVPQPLGTYWSQVLDARGQLAQQHPAADARVGIVDIGFRTTDLVTVEGGEYVPEQSRTVPTGLSAAYGAVANALLREYGIERENHALDEAIISGEIGVSGRRVDITGLREKAFEQLATKVLVEIRSTWQVADYDFLWFTGGGGLALQRYLVPQFSQASLIADPLTANSREYLAWAHYIYGTGGAPWLERTPVNPQPRQG

SEQ ID NO: 56 - protein, 384 aa, Halorhodospira halophila
MERCIGLDMGYGFIKIDDGREGHVFPSVVGEGESGMPMSLGVAQRSGSSELRITYGGKSYLLGDYAIRHSRLAHRGLSPTRAEGDDLKILFLGALSLYARETVNNFHVVTGLPPGRMHMADDLVRQLRGDHEVIRHVGASRFGVSIRLEQIEVVPQPVGSFWAEVLDDRGQIRGDHPLLNGRVGIMDIGFRTSDFATVIDGEYSPGFCKTVPLGISFGYEEIAQELSTQYGLEREQYTLDEAIIQGQVNVNGRPVDIVELRDRIFGDIATKLLVEARSMWQIQEYDHIIITGGGGRVLERYLRPELSQAQLAQDSVTANARGYFNWAYFNAQQRAAEMGHATEQSSAEDYSSGSYGTGSTTYSRGGDDGRDSAAVPQSRSGSEG

SEQ ID NO: 57 - protein, 348 aa, Desulfatibacillum alkenivorans
MDVLGIDIGFGFTKATNGKEFLMFKSLLGEAAEIPFRANLANSSFTENLHVTVDEQTFFVGDFAERQSGVRQSTLDQDLLVQEFAKVLALTAAGIFSEKYAPMNVVSGLPVGYFTEYKEAFVKAILGHHTVNYHKADGSVVTRRININRVRMIPQPMGSVLNLLMDERGRITDRDLANKKVGVVDVGFKTTDFIIFDKLQFITRGSRTIDTGISDIFRTIANKLRKQVDVSLELYRLYDPVSKGSIRIRGQELELAEIRDHVYAQAAGEIADEINQIWADDWDMDTVVLTGGGGMELAKHLQPLIAGNVVGIPNDVDARLNNVQGYLKFARHLWEKDEPPPAREESAE

SEQ ID NO: 58 - protein, 345 aa, Thermoanaerobacter pseudethanolicus
MFKIGLDLGYGYTKGINETGRMVLFPSLVGNAYQRNLIGLFGQNLNNLIENMHVVLRNGKEEQEEYFIGDLARREGRNVSYAFDENKINHPNTKAVLASASALLFPSNDEPVHIVSGLPLEQYIHQKDELRDMLKNFKAIVEFKGYNILKIVKFDRVTVFPQAAGAVYYAIMDDLQKYLIKGSYIGLIDIGYRTTDYIVFVVDGKLSLREDLSGTLDIGMSQLNNAADKLFTQKTGSKLDIPELIQLVNEGSIFYRGKVLNFEKELNEVKLEISRVIQDRIKAVWGSKLDFFNTIFLAGGGAVSLFDSLKNLYENTVLVKNSQFANAKGFLKVAELEEKKERDRE

SEQ ID NO: 59 - protein, 350 aa, Clostridium botulinum
MNKYTIAIDLGYGQIKGINQDNKRVIFPSIISSGKDRSLDTFFNSIDNIVDNIHVKILDEYFNEKEYFVGELAKRQPSNSSFINRDNKINSEENKVLLATALGLLIPNDLPNDTKIHIVTGLPLEHFIKQKQALNDMLKDFEHTIKFVDHNFSRNIKFEESNITLFPQGAGAIFSKINNDISSLLIKETFIGLIDVGFKTTDIVVFRINKDKEPVFEQEMSATLDGLGMINIYNTMDKAFTDNSRDGSKLNTEQLMLLCEEGKIFFKGDYIDLKKDLIKARKTLSTNIINKADGLWGSRKNSFNSIMIAGGGGKVLYNHLKLIEPNMCQLIDNPEFANAIGYLEFGKQFK

SEQ ID NO: 60 - protein, 342 aa, Thermoanaerobacter pseudethanolicus
MFKVGLDLGYGYVKGINEKGKEVLFPSLVGNAYERVLSGLFGTDNNKADNMHVVIVNENKEEYFVGELARREGKNVSYAFDEDKIYHPNTRALLTASCLLLLPEEEVPVHIVTGLPLEQYIHKKEEFKNMLKNFKVMAYFKGDEKVKTIKFEKVTIFPQAAGAVYHAVMADIQKYLVKGSYIGLIDIGFKTTDYIVFMVEDKLILREDMSGTVEVGMSALNNTVDKIFTQRTGSKIDVSELIRLISDGKIFYKGRELDFTKEIDAVRSEIARVMKDKIKLIWGSKLDFFNTVFLAGGGAKELVEYMKDFYEKIVLVKNAQFANARGFLKVAELEEKKAVNVR

SEQ ID NO: 61 - protein, 334 aa, Thermoanaerobacter tengcongensis
MNIGLDLGFGYVKGVNSQNKRIIFPSIVSIGFDRPLAGIFNTNDIIENLHVKIVDKDGENSYYVGNLARREGFSNSFALDIDKYTEPEAKALLSTAIFLLTMNENEPINLVTGLPLKQFQAYKKAFEEELKNYKALVSLPEYRLMKTVEFEKVTVFPQAAGAVYYALLEDLDKYLLSDSYIVLIDIGFKTTDYIVFFVEDRPYFLADLSGTIDAGISKIFTAMEQIYTAKTGSNLDTGDFITILNKGSIYFKGKYIDFTEEITALKKELAKLIEKRIYTSLKGILDKVMVIFVAGGGGADLYPYLKDVHTSVELVKDAQFANALGFLKVAEIQK

SEQ ID NO: 62 - protein, 265 aa, Paenibacillus sp.
MSILTIDGGGSTIKVYDGDQVRQFPSTISYDWRPRNIESKGQFDFEWEYNGEKGFAGTLAQRESDCADSLKGDTKAHPEAALRVLLALHQYCPDPAPKIIVGQPIKTHTPDEKNAIKGMLLNRRHDITVNGQRRIILIQRCEVAAEGVSAGLLIPVGGTIRVIDIGSGTVNFGTLIDRQFNDLGSFTLSTGVETTRGGVAALAHQIARAARAAKWQPEEKVNLCGGGALVMLELLRPYFPNVGVIPDPVTANVRAFHMIARKVYG

SEQ ID NO: 63 - protein, 266 aa, Natranaerobius thermophilus
MIVAVDAGNYETKVVNSHGKYSFYSDIGEYRERKLNQKHGSDDMEWEYQGERGFAGSLAKFESEYGGSMMGDSKYHRDGLLRVLLALHQYCDDNNFKIVVGQPISSHTQAEKQRIKEMLEGDHILTVNGVKKTIRILNCQVAAEGASAFWIHPQGGCVRMLDIGSGTINAATILDRRYVDKDSFTINFGANSNLTNDVKEMANAIIRKSHKWNKDDRVWLIGGIAEEIEPYLTGHFKNLKVLKPNGLHSKWANVLGYYALASGLYE

SEQ ID NO: 64 - protein, 364 aa, Trichodesmium erythraeum
MVIKQPAAAAMLTQKPSNINKKAILSADLGRTATKACVSRTQNGVVFIPSNVKQLSVDQVRAGNFESKPTDPLLDMWLEYQGYGYAVGQLAADFGANLFGDERSFAKSKIEDALVKVLACAGYFQLKGEFSVVIGLPFYNQEQFEKEKAQIISQLESPHQMFYRGGEEVEIRINKVWVMPEGYGSLLWTEANHGKEFQPQLPKLSLAIVDIGHQTTDFLMVDRFRFARAASKSEPFAMSQFYEDVASKIEGADSQSLYLLEAVHKPEGQRSYRPKGATKPINLDGIIPELRKVFAAKLCDRLIKWIPERVSDVILTGGGADFFREDLEKLLQEAGLKSHLAQPPREANALGQYIYGEAQLAISK

SEQ ID NO: 65 - protein, 389 aa, Nostoc punctiforme
MTDQPSAANPMNSAAIPMNRQPLASTTPINAVNNNPPTTTKSGGGSGKTILSVDLGRTSTKTCVSREPGSVVFVPANVKQMSIEQVRGGVFEARATDPLMDLWLEYQGNGYAVGQLAADFGANLGVGQSKVEAALVKVLASAGYFKLRDDISVVLGLPFLSLEQFEKEKAQLISQVGGPHVLNFRGESISLNVSKVWVMPEGYGSLLWSEAQPKKSPSSPDFTKISVAIVDIGHQTVDLLMVDNFRFARGASKSEDFGMNKFYELVSAEIEGADSQSLALISAVNKPRGERYYRPKGASKPTNLDDFLPNLTEMFSREICSRVLAWLPERVTDVILTGGGGEFFWDDVQRLLKEAKINAHLAAPSRQANALGQYIYGEAQLSSNRAARA

SEQ ID NO: 66 - protein, 371 aa, Lyngbya sp.
MQSNKQPVGQPAVGPNTIMNRQTTTTTTSSRRTILSVDLGRTSTKACVSRNPNEVVFIPSNVAQLTVEKARGGGFESENTDPLLDLWLEYRGDGFAIGQLAADFGANLFGGNDTDSPSKVNDALIKIFACAGYFKMKGDVEVILGLPFYSQEQFEREKEQIISLLMGPHVLLFRADQITIDIKSVRVMPEGYGSLIWCEAQKSKETPNFADLSVAIVDVGHQTTDFLTVDRFRFARGVSQSEVFAMSKFYEEVATKIEGADSQSLYLLEAVHRPAGQRFYRPRGSAKPVNLDEIVPELRKKFAQELSSRLVEWLPERVTDVVLTGGGGEFFWEDLQPLLKQAQLRAHLAQPARKANALGQFVYGEAQQVKR

SEQ ID NO: 67 - protein, 318 aa, Nostoc sp.
MFVPANVKQMSIEQVRGGVFEARATDPLMDLWLEYQGKGYAVGQLAADFGANLGVGQSKVEDALIKVLASAGYFKLKDEISVVLGLPFLSLEQFEREKAQLTSQVTGPHVLNFRGESVSLNITKVWVMPEGYGSLLWSEAQPKKGGASPDFTKISTAIVDIGHQTIDLLMVDNFRFARGASKSEDFGMNKFYELVAAEIDGADSQSLALISAVNKPKGERFYRPKGASKPTNLDDSLPNLIEQFSREICSRVLAWLPERVTDVIITGGGGEFFWEDVQRLLKDAQISAHLAAPSRQANALGQYIYGEAQLSSNRAARA

SEQ ID NO: 68 - protein, 383 aa, Anabaena variabilis
MTDQPSAATPMNAAAIPLNRVSASTPINAAPANNKPNNGSSKSILSVDLGRTSTKTCVSREPNNVVFVPANVKQMSIEQVRGGVFEARATDPLMDLWLEYQGKGYAVGQLAADFGANLGVGQSKVEDALIKVLASAGYFKLKDEISVVLGLPFLSLEQFEREKAQLTSQVTGPHVLNFRGESVSLNITKVWVMPEGYGSLLWSEAQPKKGGASPDFTKISTAIVDIGHQTIDLLMVDNFRFARGASKSEDFGMNKFYELVAAEIDGADSQSLALISAVNKPKGERFYRPKGASKPTNLDDSLPNLIEQFSREICSRVLAWLPERVTDVIITGGGGEFFWEDVQRLLKDAQISAHLAAPSRQANALGQYIYGEAQLSSNRAARA

SEQ ID NO: 69 - protein, 381 aa, Nodularia spumigena
MTDQPSAATPMNAAAIPLNRAANIPINANPATNRPNLGGKTILSVDLGRTSTKTCISREPANVVFVPANVKKMSIEQVKGGVFEARATDPLMDLWLEYQGYGYAVGQLAADFGANLGVGQSKVEDALIKVLSCACYFKLKDEISVIMGLPFLSLEQFEKEKAQLTSQVTGPHVFNFRGESVSLNITKIWVMPEGYGSLLWSEAQPKTGGKVPDFTKISVAVVDIGHQTIDLLMVDNFRFARGASQSEDFGMNKFYDMVAAEIDGADSQSLALITAVNKPKGERLYRPKGASKPTNLDDFLPNLIEMFSRDICSRVLAWLPERVTDVIITGGGGEFFWEDVQRLLKEAQINAHLSAPSRQANALGQYIYGEAQLSVGRATRA

SEQ ID NO: 70 - protein, 509 aa, Anabaena variabilis
MIPLVFGALGMAVGAVAGAFTAHAAGEKNRQEAKHHKQIANELTNKYASLAEQYYELADKNKKDVKKLTDQLALSEVEKDFLRLAVRLQQNLIFLMWEIDREPTVNALNSFQSAVEQTNQVLSQLQEELIIVPDDYYTRTLTAIEVTKEINLIIPSDTDSTNILSVDLGRAFTKACISREPSSVVFIPANVKHIPFEQIFTGAIYKYSSIPTDPLMNLWLEYKGSGYAVGQLGAKLGANLGVGQSKVEDALAKILAAIGYFKLKDEISVVISLPFLCSEQFEIEKTELISIIAGPHIMKFRGESVYFNITKVWVMPEGYGSLLWKEAQPKKRGDVPDFTKNSVAIIDIGYESTNIIMLNNFCFVKDASKSEYFGMNKLYELIASEIEGADSQSLALISAITKPKEERFYRPKGASKAINLDDFLPNLIECFSREICSRILAWLDEQEDWTMNRVTNLIITGGGGEIFWEDVQRLLKEARINAHLAAPSRQANALGQYIYGEARLRKFNS

SEQ ID NO: 71 - protein, 423 aa, Bacillus thuringiensis
MVEQMLSKNMLLGGFDTGNIKAKISFLNEKGNIESFAIPTVIAEAPPAKIDLKSAPSKKNDYVNEKDEDIELLHVRIISNSLDGDARSRAWYVGAYAKDQEDRQEPTVDEMGKTEDKFSQKNKKLHLIPLFTSMAVAAARIGKEEVSVPFSGGMPIEDYKLRGEEQILEMLYGEHTVEFLDGTYEGKKIKITINDGTMNVEGVSSVLAILFDIVNGEIVEVEGMDAEIGESYAINDLGAGTSDNAFFEDGELNKKLSTNTDLGTNKYIDEILKNIKERFMENEILKSFMTDEIESPFKTREDFIQRLVMPEVEKMIEDDTYKPTFSVKWGPVKENVTDIVMDGMLKYAEDQKASLMKFWFKTNADKNIVVGGGVLFGYAGLRDLKEQDGFILPKNIQESAYFTSRSYLIANLLEQLNKEGVEA

SEQ ID NO: 72 - protein, 329 aa, Clostridium tetani
MENITNEYVMTLDAGKYETKLIGKNKKGTTEDIKRVIFKTKIYNLEDGYIDIEGNSHKIELDGKEYLIGEQGVEDSSETSKTNLIHKLAAYTAITQVLDSNKNNKVQLVLACPLSVLRNAKAKEEYRDYIKGNGEITVKVDDKEYSFEITDITIKAEGSGVLFLEQENFKNKNVAVIDFGGLNMGFSLYRNCVVNPSERFIEEHGVKDLIIRVGDALTDLNNGNLITNEQAESALNNGYMKKGGEIDTESSTVIKKVKEKFLKDAIKLIEKRGFKLDQLDSLIFIGGTTQKLKEQISKTYPNNSIITNNSQWTTCEGLYKVAVAKYCIQ

SEQ ID NO: 73 - protein, 389 aa, Clostridium difficile
MNEKIANKIIVVDPGKNAVKVVVFSNTYELLTHYMFPSKTQIKRTFSDIDGSSDFQFRAEFEGSKYLIGEGVQSSYNFETTKNNIHHQLCVYTAIAKEVHSKNENVHVVVGYPSSDFSNEIQREKYVDLIKSNEKIDIILNGSDKSFNISEFNVFPEGMALVPRMKFPKRKVRVIDIGGQNLNHRLYDEKGNTLESFSLDEAGINHLEEYLRTTLRKNINADMVDIDSINILEAIEKQKIDAISDDMINGYDSVASFIENTVLDFIDNKILNQLSSKNVFLYKRSHLIIFTGGGSITLKKYLEELLPNNIGNLYFSETATWDNCASYLIKDLTLKFKDSKISKIELANYTKKIVKAFNDLIIGITPSTEENLTEDEELINRKRKTVKQK

SEQ ID NO: 74 - protein, 324 aa, Natranaerobius thermophilus
MSNNILNCEIDLGYWFSNLRTRKILGEKNIRLRSKVEFTTDALISGAGTYHFRHDDLKGVVGEGASQHSLELDKTRDKAYKVLAYSLIALAIEKNKDQMERDKEFPIINLVTNYPLNIYNGQTKEQFEEFLKTSDFIHVFVNREHKLFWLKNCTVFPQTVPVSYANPSAFKNQIKGIVDIGGMTTQGVILDSFNIIPSSRFTENLGCLNLYNKVRKALNSYFTVNIQDYEMPTIIKNGLRVNTKKSLEIIDEIIRDHIKEIQNAMTVNNWNEENIPIMFTGGGSLLLREYLEEMFPHVEFSQDPLWDNAKGLRKVGEIFYGRQN

SEQ ID NO: 75 - protein, 343 aa, Acidovorax sp.
MELIVRAVDVGSGNTKFVTGVTGTEIRCASFPSIAYPSSGETPQWPASERRKTVCIPVGPLFYEVGPDVGLAADTFRAKQLHDEYTESPEYMALLRGALSMMKVPHIDLLIVGLPVALFILKKAALEKAVVGSHQVGGGKTVTVAKAMAVAQPQGALVHYAAEHQKIETIGTEQSLVIDPGSRTFDWLVTRGMRLVQKQSHSINRGMSDVLRLLAAEISKDIGTPYRDFDAIDLALRTGKAPVIFQKPYDMKKHLPLAESVAQQAVSTMRQWIETPESLQNIILVGGGAFLFKKAVKAAFPKHRIHEVKEPMFANVRGFQIAGHNYAASAMASGRDRGAGEAV

SEQ ID NO: 76 - protein, 394 aa, Polaromonas sp.
MKPETPMVDVRAVDVGYFSTKLTLARNLEGNASTIASMKPETPVVVDVRAVDIGYFSTKLTLGRKLVGNASTIATALFPSLAPRLPASMSMQTALHGKPDGSVVDVDDVNYFVGRDAILYSSGREPREVLADYSMTDKYHALMRGAFHYIAQDAKATSELVIRHLVMGLPLNTFGENRDRLAARATGEHLLPDPSNPGSMRRITVEKASVIVQPQGALVSYGTTHREIFKEGWVLVVDPGGGTLDWYVARGRLPNWQRSGAYPKSMLACAYAVADRIDPTWRDNFEIIERIDKAIRDKAPSFMTAGNTYELAPYTSAIEAVLKESTDKMVARLGSLDNLDLILFTGGGAKVYFDFFKSRNPKLTNIMFMDDDPVFSNVKGFHVAGEIMSKSRTI

SEQ ID NO: 77 - protein, 350 aa, Ralstonia pickettii
MSKSTPAIVRAIDVGYGNTKYTLSQRNIDMDAEVGLFPSLAPRATQSDFTGGLMAKADRIVVQVDGESYSVGMDALAESKGIYKREVASAYSTSRAYRALFLGALQKMRLTAIDYMVVGLPLTTYDRYAKELTELLTGTHEVPNPMALDQALKVTVRRVKVFPQPSGAFYNYAVPRKLLQSMSQQTNLVLDPGYGTLDWFVTEGAKPLTGRCSATPKSVWAVISAVADHIGPDLTSNPRTMSRIDNALRTGAPLTINGKTIDISPFKPIVDQIVADAINDMLMSIGNLSDIDNILITGGGAHLFVDHVKKELGKTHSQIHVDTDPVYSNVRGFQYAGEFWAGMDRQRAAA

SEQ ID NO: 78 - protein, 369 aa, Rhodoferax ferrireducens
MGLFPERLYQTARIEQVQHTTVFMSKTPPTFRALDLGFGFTKFSKGHYLQDGSLEVSAFPSYAAAAVNFSIGAGVMTDLSIVKVSVDDEHFLVGEDVRNAADGVGRQMLESTFFTSSQYIALARGAMGFMNVPNHGEVDSLVMGLPLNIFRDQSIVDHVEAAMKGTHLVPDITKNSGVERTILVKNVSIIPQVVGSLVAMSRDAGLMQKVNEQHNLTIDVGYGTLLWLVSDGFTPVPARSNGNMGGVSSLLQKIIRSIDPSAVSSINIMDRLDKALLEDKASILINGAEVEVAKYHRQLASAARENLTEMIRSIGTKADIDNVFLTGGGAHLYKDAIAAVFPGRQVHIASKGSRFTNVRGFQFLAETED

SEQ ID NO: 79 - protein, 341 aa, Ralstonia metallidurans
MKQQNELIKHPTIAIDVGYGNTKTAWAMGAEIATNMFPSLAPLAANSSLNAFGGGVFKGRNVLNVEVDGARYEVGPGVSISGAHVHTGRSLSEDFATTAGYAALLAGALHYAGAREVDRLVLGLPVHNTQKYAAHLKERFAGTHNFGWGDIHVGSVLPLPQPLGTLIHYIQQRGKQYDPDNSYLVIDVGYFTTDWVVARGYTVDDTRSGGVPGGAARIYQQVASLITADRNQPDVGIERIDQAIRDAKPLVYFGEDLDMGPYLSEAMALTNQPVKEIQTRVGRTDDLRAIILTGGGAQLYAPAIRAAFPLNPIHMMDSPCFANVRGFYTIGAATRQASRAA

SEQ ID NO: 80 - protein, 347 aa, Dechloromonas aromatica
MELIVRAVDVGSGNTKFVTAAAGTDIRCASFPSVAYPSSDDSPSWPASERKKTVCIPIGPLFYEVGPDVSLAADTFRAKQLHDEYTETPEYMALLRGALSMMKVSHIDLLVVGLPVALFTVKKSALEKAMTGRHDIGNNKVVTVGKAMAVPQPQGALVHYASEHQKMVEIGNEQSLIIDPGSRTFDWLVARGMRFVQKQSYSFNRGMSDVLRLLAAEITKDIGSPYRDYDAIDLALRTGKQPLIFQKPYDMKRLLPLAETVAEQAVSTMKEWIEAPHSLQNIILVGGGAFLFRKAVKAAFPKHRIHEVKEPMFANVRGFQLAGQNYARSKMTATDRGQVQGASGELE

SEQ ID NO: 81 - protein, 334 aa, Burkholderia ambifaria
MKTAVFAVDVGYGNTKYAHRAASGTIATGMFPSLTPLAASRTLSGYGESVLTARKVSTIVIDQVEYEVGPDVPLTAAYGNTGRALADDYVLSDNYAALLFGAIHFSGVTHIERLVLGLPVHNMKKYSAELKERFAGELDFGAGRVTVDKVVVIPQPLGSLVLASSNRQHEFGRDVAHLVVDVGYFTTDWVYANGFTMDDNRSGGMPGGASQIYQRIASLVARDQGDEVEDIERIDKALREQTPFFFYGTNIDLAPYLEQAQPLISGVVKEMQNNVGRLPNVRSIILSGGGAALYAAVIRRAFPRVLIEVIDAPCLANVRGFLMVGEAGLARERR

SEQ ID NO: 82 - protein, 333 aa, Cupriavidus taiwanensis
MNTTKTIAVDVGYGNTKFAFPLGADVATRMFLSLAPTRSASSLANHGDGYFQSRDVVHVTVDGAEYEVGPDVSITSAYGNTGRTLSEDFVTTPEYAALLFGALHYSQARDVGQLILGLPVHTLQKYAGVLQERFAGTHDFGAGSVSINRVVALPQPLGSLVTFMRQSGKDLDPDDNCLIVDVGYFTTDWVVARGYMMDDTRSGGVPGGSSRIYQQVAQLLSADEGGEPSGSIERIDKSLRDGKLMRYYNKMVDLRPYFEVAKAQCQTAVKEMQTRVGRTEDIAAIVLTGGGSALYSGAIRAAFPRSHIVAMESPCYANVRGFFDIGSARQARG

SEQ ID NO: 83 - protein, 332 aa, Ralstonia eutropha
MSTNTIAVDVGYGNTKFAFPLGADVAASMFPSLAPTRSASSLASHGGGYFQARDVVHVTVDGAEYEVGPDVSITSAYGNNGRTLSEDFVTTPEYAALLFGALHYSQARDVGQLILGLPVHTLQKYAGALQERFTGAHDFGAGDVTIKRVVALPQPLGSLVTFMRQSGKELDPDDNCLIVDVGYFTTDWVVARGYMMDDTRSGGVPGGSSRIYKQVATLLSADEGGEPTGDIERIDKALRQGKLMRYYEKMVDLRPYFEVAKAQCQMAVKEMQTRVGRTEDIAAIVLTGGGSALYSGAIRAAFPRSHIVAMDSPCFANVRGFFDIGSARQARG

SEQ ID NO: 84 - protein, 332 aa, Ralstonia pickettii
MKAATVAVDVGYGNTKFAFPMGSETKLNMFPSLAPQAAPRALANHGNGFFKARDVITIAIDGVEYEVGPGVSLSSAYGQTGRTLSEDFVTKDEYAALLGGALRLAQVSEVGQLILGLPVHTTQKYASYLRDRFTGTLDFGGEPVEIGSVICLPQPLGALVTFMRQQNTKFDADNAHLVIDVGYFTTDWVVAQGFTMDDNRSGGVPGGSSKIYQQIASLIEQDEGEPVTGIERIDKCLRDKKPMLFFDKEIDLTPYLEKARSVCQLAVKEIQTRVGRTEDIRAIILAGGGSALYVPAIRAAFPRTPIHALSSPCFANVSGFYDIGSTRPVKQK

SEQ ID NO: 85 - protein, 332 aa, Ralstonia pickettii
MKAATVAVDVGYGNTKFAFSMGSETKLNMFPSLAPQAAPRALANHGNGFFKARDVITIAIDGVEYEVGPGVSLSSAYGQTGRTLSEDFVTKDEYAALLGGALRLAQVSEVGQLILGLPVHTTQKYASYLRDRFTGTLDFGGEPVEIGSVICLPQPLGALVTFMRQQNTKFDADNAHLVIDVGYFTTDWVVAQGFTMDDNRSGGVPGGSSKIYQQIASLIEQDEGEPVTGIERIDKCLRDKKPMLFFDKEIDLTPYLEKARSVCQLAVKEIQTRVGRTEDIRAIILAGGGSALYVPAIRAAFPRTPIHALSSPCFANVSGFYDIGSTRPVKQK

SEQ ID NO: 86 - protein, 333 aa, Burkholderia ambifaria
MKTAVFAIDVGYGNTKYAHRAANNAVASGMFPSLAPLAASRSIAGYGDSVLTARKVATIVIDQVEYEVGPDVSLTAAYGNTGRALADDYIRTNNYAALLLGAIHFSGVTHIERLVLGLPVHNLKKYAGALMERFTGTLDFGAGRVKIDKVMVIPQPLGSLVLASSNRKGGFGRDVEHLVVDVGYFTTDWVYASGFAMDDKRSGGMPGGASQIYQRIAQLIARDQGDAVEDIERIDKALREQTPFFFYGNDIDLAPYLEKAQPLISGVVKEMQNNVGRLANVRSIILSGGGAALYASVIRQAFPRVVIEVIDAPCLANVRGFLLVGESSVARER

SEQ ID NO: 87 - protein, 334 aa, Burkholderia multivorans
MKTAVFAIDVGYGNTKYAYRAATNAVVSGMFPSLAPLAASRSIAGYGESVLTARKVATIVIDQVEYEVGPDVSLTAAYGNTGRALADDYVLSANYAGLLFGAIHFAGVDHIERLVLGLPVHNMKKYSAELKERFTGELNFGAGRVTIDKVMVIPQPLGSLVLASSNRQGGFGRDVEHLVVDVGYFTTDWVYANGFTMDDKRSGGMPGGASQIYQRIAALIARDQGDEVEDIERIDKALREQTPFFFYGSNIDLAPYLEMAQPLISGVVKEMQNNVGRLANVRSIILSGGGAALYAGVIRRAFPRVVIEVIDAPCLANVRGFLLVGESSLARERR

SEQ ID NO: 88 - protein, 305 aa, Burkholderia vietnamiensis
MFPSLAPLAASRSIAGYGESVLTARKVATIVIDQVEYEVGPDVSLTAAYGNTGRALADDYVLSANYAALLFGAIHFAGVDHIERLVLGLPVHNMKKYAAELKERFTGELDFGAGRVKIDKVMVIPQPLGSLVLASSNRPGGFGRDVEHLVVDVGYFTTDWVYANGFTMDDKRSGGMPGGASQIYQRIAALIARDQGDEVEDIERIDKALREKTPFFFYGTNVDLAPYLEMAQPLISGVVKEMQNNVGRLANVRSIILSGGGAALYAAVIRRAFPRVVIEVIDAPCLANVRGFLLVGESSLARERR

SEQ ID NO: 89 - protein, 354 aa, Dechloromonas aromatica
MLAARKSIEEPHMDYIVRAVDVGFGNTKYVSNVVGSDIRCTNFPSVAYPSMREPSGQPGYERRKTVAIPVNGLFYEVGPEVELAADTFRATQMHDRYTETPEYTALLRGALALMKQPEIDLLVVGLPVAALTTKKTALEKAVTGTHDIGNGKNVVVRKALAIAQPQGALVDFVEQHGKTTTIEREQSLILDPGSRTFDWLVARGMRLVQNKSHSVNRGVFDILQAIAAEIGHDIGTPYNDIEAIDLALRTGKNPVIYQKPYDISRAMPMAHSIAQQAVASMMRWIDASYSFQNIILVGGGAYLFKKAVKEAFPKHRILEVKDPLHANVRGFQIAGMNHVDKLFSGTATATHGGA

SEQ ID NO: 90 - protein, 344 aa, Bacillus weihenstephanensis
MTVDYIGVESANSFVKVASANEELCYLNTLRRVESFEDTTGLTVYTYEGIRYVIGEAQGISSSARNDDRYSSAGYRTETILAISQLVKDGSEIVVGTGLPSEDYKNGDNHEKVKRNLVGEHTVQIDGKTKTFSILRVYTPMQPIGSVVNRIYDYNLKVRKDMESERTARKLVIDIGFGTTDVCEAEGLRIVRYDGVQVGMLEANRIIKDELSKRGARGIVSLLHMDTLLRNAKREYVKDEFTDKEILSKVIIEIGGKEYEIKDLMEQALEYTARIVMQRVDNLGYVLKDYDVVLFTGGSLLALHKYIKPYLTGVNTKAEQGAQTANVKGYTKYAMIQDAKAVAK

SEQ ID NO: 91 - protein, 355 aa, Polaromonas sp.
MPEIVAIDLGYGHTKVVSQGRDGEIKRMIFPSVAPITTRERTAESNGMGALRTVTVCVGANNYVIGKDAYLEADSNYSRSRLDEYSQTDGYHALMLGALALSGLREIDQLVIGLPLTTLDTYHSVMSSKYLGEHSIGATYARRKVELAVRNVLVTSQPAGAMINAVAGQPGLKKATNLAIDMGYFTMDFLMCEGLRPFYKRSGAVQGGMSGYYDHLNGMVAEKITSEGLPAQSTVDHFRLEETLSNGIQGENGRTIYSLRIGKLEVDITECVERASTRLTEYLDRMMTTLGGGSSMGIISSVVLAGGGARMILPAVKERFGKTHDIVMQDAAQYAIANGFLHFGLASAKRAAAQV

SEQ ID NO: 92 - protein, 355 aa, Shewanella sp.
MNNPVIITVDVGYGTTTCVHKESLGNYSVKTFPSLPIPIKSDINLGLAGEERDVTNVEVDGITYEVGSDVGTSVGSRNVRVLNTESFITSDRYKALLFGALSFLGKSNHIDIDVLVLGLPVSVMFRKDELAKIYTGTHQITPSRKVTIRQVLVFEQPLGALMSFLRQGGNERFAQCKDKTMLSIDPGYMTTDFITSKGLKVSPNRSGDSETGMSKVIGAVEVALRSQLEGFNIKQINPELIDQAFISGELKLYGKAMKFPKCDLFDVTSAIRSVTDEALTSVVNKVGDGQDIDLIIVSGGAAAVYLPSIQRAFPFHKIEVVDDSLTAVARGLQTAGEQFIRGAIARGDYQKLKAV

SEQ ID NO: 93 - protein, 305 aa, Clostridium perfringens
MLKLGIDLGNGYTKFKGSKFASKTKVGRLASLAGLGEKPKDIHEVGYKGTTYIVGDGEVFTSPDRYFGLDYEICLLTAIGLSSKDIVIDANICVGLPIIYFMSETKVLLEKKLNELTEKDSIKITINGQDKIIKINNARVFAEGAYVLDCMDTDNIITIDLGAGTVNITQWDNLIPISYDTITKSFNKLYRDIANHIKNTGRGVVTPAYIEANFGEDTITIDGKVVDITDTKQMISKYVSAIVSNVYDICDVPQANKIQIFGGGAIATEEYWKDAFGKDRDGVSVLPNSQYTNSKIYQKAAEILK

SEQ ID NO: 94 - protein, 305 aa, Clostridium perfringens
MLKLGIDLGNGYTKFKGSKFASKTKVGRLASLAGLGEKPKDIHEVGYKGTTYIVGDGEVFTSPDRYFGLDYEICLLTAIGLSSKEIVIDANICVGLPIIYFMSETKVLLEKKLNELTEKDSIKITINGQDKIIKINNARVFAEGAYVLDCMDTDNIITIDLGAGTVNITQWDNLIPISYDTITKSFNKLYRDIANHIKNTGRGVVTPAYIEANFGEDTITIDGKVVDITDTKQMISKYVSAIVSNVYDICDVPQANKIQIFGGGAIATEEYWKNAFGKDRDGVSVLPNSQYTNSKIYQKAAEILK

SEQ ID NO: 95 - protein, 305 aa, Clostridium perfringens
MLKLGIDLGNGYTKFKGSKFASKTKVGRLASLAGLGEKPKDIHEVGYKGTTYIVGDGEVFTSPDRYFGLDYEICLLTAIGLSSKDIVIDANICVGLPIIYFMSKTKVLLEKKLNELTEKDSIKITINGQDKIIKINNARVFAEGAYVLDCMDTDNIITIDLGAGTVNITQWDNLIPISYDTITKSFNKLYRDIANHIKNTGRGVVTPAYIEAHFGEDTITIDGKVVDITDTKQMISKYVSAIVSNVYDICDVPQANKIQIFGGGAIATEEYWKNAFGKDRDGVSVLPNSQYTNSKIYQKAAEILK

SEQ ID NO: 96 - protein, 303 aa, Clostridium kluyveri
MVILGLDNGYHFTKTSEGVMFSSTVRKGKDIDINADTIQTNIDGQDYVVGAPNGEYVADSNKIDSIVTEICTFTAIAKSFPENKLIDCNIVAGLPVSYYSKQKSDFKEKLLGYGNKKVKLNKHNFQINIVGAEIYPQSAGVVFVNSKDVKSDDSLVVDIGGGTVDVSAFHGLRLTNMATYNLGMLVLYSKLAQKLNSEYECKFMDYELYDKLKKGYITSNKFGRIDLEILNDDIEEHTNVILNNIKRDFNYNSMDNIFVIGGGGVELYDRIKQKFKNAILCDDAQFVNANAFELMGQMKFATK

SEQ ID NO: 97 - protein, 302 aa, Clostridium perfringens
MKILGLDNGYNYTKTSKNICILSTVEKGHDDYNNVLEMNFNGENYIIGEPTGQYIVDANKFKTEEGKELLRVTTLAAIGLSYPEESVIDVSIVAGLPVAFYADQKEELTKLIKGLDDSCIEINKLGKKQIIKIDKVMVLPQACGIIIEKNKKNESSLVIDIGGGTWDIAQFTGLKLVEKATYEKGMLVLYSAIAQELNAKYYTKFETSDIQNIIDRKYFTVDGVKKGIEDIEEYIDNYVRKIAATIKRDFDTTNIDNFYLIGGGAISLESYVKKYFPSIEVEKECQFTNVNSFKFMGELKLK

SEQ ID NO: 98 - protein, 302 aa, Clostridium perfringens; identical to SEQ ID NO: 97

SEQ ID NO: 99 - protein, 353 aa, Burkholderia vietnamiensis
MTKNAAVSEEVGNVVHLQPEGEVRFAGTDDGHDGIKIVTDDWRQIHVPSRITRGADLISLNDADDNVYEGPDGTLYAVSPTLPYFDTTFSDYALSDINLVLVHHALAKAGLGGQRVNLVTGLPVGDYYVANRPNVDFISRKVAHLRENTVRNKNESVALATIVKHNVVSEAIAAFFDLLLDREGNQRDDVAEMVATGGIAIVDIGGKTTDTAVVMNGGRDVDGKRSGTDPIGGLSLNKAVENELKAEFSVTALNPAQVDRAVREGVLRLYGKDHDCRAIIDKQKSELAKQIIAATHRKMRDASDLERVFFVGGGALLLCDQLEELYQHAEFVEDPQFANARGMLKAAMFLQPR

SEQ ID NO: 100 - protein, 316 aa, Yersinia pseudotuberculosis
MFSIPSRASYDVSIINIEGNDKSFIFETHNNKKFTVDESVPSPLDTRNIAIPYPVSDLNRVLVHAALINAGYAGKDVHINTGLPVSHYYKPSTEINQTLVEQKKANLMHPVRCGIDGSLPVANIIANEVCSEGVAAYVDQLLDADGNTTEQYEEMYNSVVGVVDIGGHTTDCAVLLPKMVINMTRSGSSEVGVLNLYDGIKTAVAAKFGINSSSITKRQIESALNTGKIMISRQAIDVSDIVNTEKTRLFDQIIMAINEVIGTDEDIEKLIFVGGGSIVFEDYLRDHYKSIIIPEHPEFANARGMMKLVKYIPKSN

SEQ ID NO: 101 - protein, 328 aa, Acinetobacter baumannii
MGKSFRLPSRVANGRTIIGDTDEVNKQIIHVNGKYFTVDEFTKEHIDTRTEDYPLSDANVALVHHALHQAFDGQYRKFKIATGLPLNRYYGGKDKAKNEKLIADKTQNLLINKDFNNPTVYNLYEHDKKNDPLQILNHIVLSEGQCAYFDALMDDNGKRSSMYEDLWEGGCAIIDIGGRTTDIAMINPRGGTMQASRCDTLDVGIITLKNKVSQNLKEFFGLSSNITDWRLSKALKTGIYNHGGKDHDISKILNAAKVEITDQIENSIKVNVQDGQDLGAVLLVGGGSITLGDELLKRFNYDNWHLVKQPEFANARGMYKCAKYISKL

SEQ ID NO: 102 - protein, 293 aa, Clostridium butyricum
MQNYSISGIDIGHATCSTSNNVLFESKITETEPLNKASKLIIDNKELWLGEGNYDTTYRKVDKKNYINFLYGALALSTDTVYNYIVLGLPLSQYKEDKAALTNLVLNNNEKSVIINGIQKPLVIKDVEIYPEGVVTLDDEWEGIVVDIGGRTTDCAMVINERNRRKIINPISLPLGTINFQTDLIKKINNKYSLDLQVNDAERILKNGLILDGEIIKDDSIEDMYNLFVDKLINQLQVEYSLRTNFISLTGGGANLFYNSIRKQIGENSVSLQENSIYANSQAFGELGESIWQ

SEQ ID NO: 103 - protein, 349 aa, Lactobacillus paracasei
MEIFSLDLGNKQTKLKSSKSEYVLPSRYLNQADMPMSVGSSTTNNDLHIYSVPFSDDKYVWGRDIDGLHLDEYLADTIMYGNRYNSEAFKLLANFALGLLASDFKIANNQVLEVVVTAGLPTGDYADQERLRSLLKVLEGQHQVTIDDQIVTVRVRKVYILPQPIGTLYNELLDDQGFIKNKALLDEKVGIVDVGGGTILIDTILNFELSGKNRQQFNTGVNDLYEAIASRIEGDVSLYQLEKELRHGNQQHQWSYRFSKNRQDDITELVGKESDRFTRRLVANVTSTLKNLDSIDTLFFTGGGANLINQKILKTTFTNAAIVKDTEVANVNGFYKYGLSQQVQEKEGK

SEQ ID NO: 104 - protein, 418 aa, Lactococcus lactis
MNIFAIDLGNKRIKMKSERGEYSYPSSYLNAEQVVTGGLGSEIIEQNYHFQTIQDSTNSFIWGPNLEVYNLPERMIDTYARSGRMKQKKTIRIFEFALGRLVMDFPEAFESPLVVHLMLGLSITDMHQESDTIDMLKKLAVGQHQIIIGGRVVTIIIPSEEFLSIIPQYMGTVLNLAFDQDYQRNRRFSDGRIGVIDIGGGTILINRSVALNPSPIGDERFEGIQNLIKEIGRRINSTKSFLIEEMLRSVDSEGNYVYPPNSNVQDSKNVSPIVEGEIERYTRFTVAPLVTENFPDIEEVDFIVVTGGGASLLAKEALKDEIGEEYFSRLLFLNESEFANVRGFYKGGYLKWHSSNEELAVEARREKPAELQESQTRDVIVPPIRNTETSMDRELLEAQQKLQALQSEIDGVQIEFEN

SEQ ID NO: 105 - protein, 369 aa, Desulfitobacterium hafniense
MFENDILVAGGDPGFGAIKLDAGDTKVLFPAVICKGNERIFSALGNGNVSRGTDEEMQIGSLDVIVTNHSTGVSRHYFMGSLAESLNPNEAHYCWDEDKSTDEEATALLVVALAVAQKEPKANIYLGTGVPVKYYAALKDKYEAELKGTWSVAFRSGPFKGQTRQLTIIRSRVLPQSYGVFIKETLNEYGIPISPKLFNGYVVVIDPGFRTTDVATFYDGVMLDPPNSFSIEKGLKWAYTGVAEQLKEMTINHANPIETDDKELDKVFRVNEGMYPWNNGAINLNPVMQDMLGQLGTDISREVKKSLKPMLGKIHTVLVAGKVGEMIFEHLQFENKVLIENPQFGNATGFRIMAANLVNNITKKANAAP

SEQ ID NO: 106 - protein, 368 aa, Desulfitobacterium hafniense
MFENDILVAGGDPGFGAIKLDAGDTKVLFPAVICKGNERIFSALGNGNVSRGTDEEMQTGSLDVIVTNHSTGVSRHYFMGSLAESLNPNEAHYCWDEDKSTDEEATALLVVALAVAQKEPKANIYLGTGVPVKYYAALKDKYEAELKGTWSVAFRSGPFKGQTRQLTIIRSRVLPQSYGVFIKETLNEYGIPISPKLFNGYVVVIDPGFRTTDVATFYDGVMLDPPNSFSIEKGLKWAYTGVAEQLKEMTINHANPIETDDKELDKVFRVNEGMYPWNNGAINLNPVMQDMLGQLGTDISREVKKSLKPMLGKIHTVLVAGKVGEMIFEHLQFENKVLIENPQFGNATGFRIMAANLVNNITKKANAA

SEQ ID NO: 107 - protein, 308 aa, Clostridium perfringens
MILGLDIGNITSIGVGDKEDFITESRLREFEELDDFSGNDIVEINDKKFIFNEGYFENNVVKHEKENFINLLYYTIAKTLDKENSKENDVKIVIGVPAGQYNSEKERLKKVILNNQCKNIKINGESRTINIEDIFIAPEGYGAKVEALQAKKEKVKLLMVDIGGGTSDVALFDENGRFIGGKSIKVGLLDLYKNVQEVLDLKYKLSVSLEDARKYFDGELDIRNEKFEVENTYKTEALNKLVKFLINELRGLYPNISQYAICLCGGAAGRILPVFKKVYIQAEAITDIKANAKGFRKVGLAKWQNQGK

SEQ ID NO: 108 - protein, 308 aa, Clostridium perfringens
MILGLDIGNITSIGVGDKEDFITESRLREFEELDDFSGNDIVEINDKKFIFNEGYFENNVVKHEKENFINLLYYTIAKTLDKENSKENDVKIVIGVPAGQYNSEKERLKKVILNNQCKNIKINGESRTINIEDIFIAPEGYGAKVEALQAKKEKVKLLMVDIGGGTSDAALFDENGRFIGGKSIKVGLLDLYKNVQEVLDLKYKLSVSLEDARKYFDGELDIRNEKFEVENTYKTEALNKLVKFLINELRGLYPNISQYAICLCGGAAGRILPVFKKVYIQAEAITDIKANAKGFRKVGLAKWQNQGK

SEQ ID NO: 109 - protein, 308 aa, Clostridium perfringens
MILGLDIGNITSIGVGDKEDFITESRLREFEELDDFSGNDIVEINDKKFIFNEGYFENNVVKHEKENFINLLYYTIAKTLDKENSKENDVKIVIGVPAGQYNSEKERLKKVILNNQCKNIKINGESRTINIEDIFIAPEGYGAKVEALQAKKEKVKLLMVDIGGGTSDAALFDENGRFIGGKSIKVGLLDLYKNVQEVLDLKYKLSVSLEDARKYFDGELDIRNEKFEVENTYKTEALNKLVKFLINELRGLYPNISQYAICLCGGADGRILPVFKKVYIQAEAITDIKANAKGFRKVGLAKWQNQGK

SEQ ID NO: 110 - protein, 316 aa, Caldicellulosiruptor saccharolyticus
MKCGIDVGFGFTKAASEKGKKVVFPSAVAKTFMTDVGLKPTSDYFVTYMNQTYAVGRAATQCLITETSFSEERFSTDFSKLLVLTALMALECDREVELGLGLPLMLYPKLKEKVKDYFEFSEEIIINSNGIAHSYHITRCEVFPQGVGALFSISSPVEDGIYCILDVGFRTTDVIVVEIRNRNINPLLDMCFTVDKGMSLAIERLGLMIERKYGVSYDTSLLFDIHERSHISVRGRKIDIEAHKKEVFTAIADDIVQSISRRLQRGFDTFDAVLVAGGGAFNVASVLQKEFENVYVLDDSQFANAKGYLTLLNLGV

SEQ ID NO: 111 - protein, 236 aa, Caldicellulosiruptor saccharolyticus
MLVLTALMALESDREVELGLGLPLMLYPKLKEKVKDYFEFLEEIIIDKNGVAHSYHIARCEVFPQGVGALFSITSPVEDGIYCILDVGFRTTDVIVVEIKSKNINPLLDMCFTVDKGMSLAVERLGLMIERKYGVSYDTSLLFDIHERTYISVRGRKIDIEPHKKEVFRAIADDIVQSISRRLQRGFDTFDAVLASGGGAFTVASVLQKEFSNVQIVENSQFANAKGYLALLSLGL

SEQ ID NO: 112 - protein, 333 aa, gamma proteobacterium
MDALAVGLDDGYAVTKVALATGQLFAVPSRGRIGSAKITAVNQNDTGIAEYMSGDEHIAVGVDDFDATGFDDYPLSAVNRAIVQHALLAAGLSGRSIHAVSGLPVARFYHSDGQRRDALIASKTKSLLAPVQPLDGRPPVSIACHDVIPEALAAWYDHVIIEDGTEWVRLDESAVEAPLAIVDIGGRTTDFVVVADEKLWHQSSGSITCGLLDLRGSVAEAICAVHDLDSLSDAGVDQALTENTIRLFGKDHDVTAIVSKARQQIVLRIEQETRRRLGRGAELERVLFVGGGSVVLADAIRHWFPNQAIAPHPAFANARGMLKYLRYVGLPSE

SEQ ID NO: 113 - protein, 363 aa, Nitrosococcus oceani
MTELTDEKTTDQRQASIADDPMQVVQVGLDDGYAYTKVALPDGRLVSVPSRARMGAAGVTWIRDVEQRIFEYETAGTVYSVGAVDGEPTQFDEYPGSALNRVIVQHALQEAGLSGRSLHLVTGLPVAAFYRGDGQQRRQAIQTKRDGLKLTVEPVVAKKSSTRQALKASIAFHEVIPEALAAWYDFVIVTLDDGVTLDADRLNAPIAIVDIGGRTTDYVVVQDQGVVHGSSGSLNRGMLDLKLRVANLIQERFDLHELGEQIISRAVDTNRLRLHGKDHDVSDMVMNAKRELVERLYAETRRKLGLGVELDRILFVGGGSAALSSDIADWFPNQTIADHAAFANARGMLKYLQFVCDDASKER

SEQ ID NO: 114 - protein, 363 aa, gamma proteobacterium
MTERIDKKPTQADKTSQLTSDPMSVVQVGLDDGYAYTKVALADGRLFSAPSRARIGSAGVTWIREQEQRIFEYETGGTVYSVGAVDGEATQFDEYPSSALNRVIVQHAFQQAGLSGRSIHLVTGLPVSAYYRHDGQLRQQEIDRKCESLKLSVEPKPNSAKPGKSILSASVAFHEVIPEALAAWYDHVIVTQADGVTLDGDRLSAPIAIVDIGGRTTDFVVVQDQGIVHGSSGSLNRGMLNVKSRVADLIQQTFDMSELGEQSIARAVDSSRLRLHGKDHDISAMVAAAKRELVELLYAETRRKLGLGVELDQVLFVGGGSAALATDIANWFPNQTIPDHAAFANARGMLKYLQYVCDDTAGG

SEQ ID NO: 115 - protein, 346 aa, Marinobacter aquaeolei
MKTKRRAIDNGYNHHKVAWVEDGKIKTIKYPAILGSSTEAMTELGGGYANMYESTSGERFVVDEHVSNRISLRTGDYGLTEGNRVLVNHGLRETGIKPDDEVMLVTSLPVRDFFSSDGSRNEDLIAGQKESMMKPVKVVLNNTDDPVRVANIVRSDVVSEAVAAAFDFLVDNVGESAKPLHAPLAVLDFGGSTFDVVTLTKDLRIRHASSGTLKRGTMDIIEPLKRLLLKHAQEMKIKVSEIPDWMINQVMATGKMPYFSYEDGKPKNTEMPVNDVIEAAAAETVSEIKAFVKQKIANFSEYQAVLLVGGGSLLCRKLFRDWEELPQFIVMDEFANARGMLKLVSI

SEQ ID NO: 116 - protein, 346 aa, Marinobacter sp.
MKRPLSIAVDNGYYDHKVAYWDGDVIRTFKYPVVIGSKHEVMSTMDGQLVGMYETEGVRLVVDPTINNKIPLRYDEYGSSKENRTLVSHGLYKAGVAGGQEVHLTTALPFRDFYNIDGSLNRPLIDAQKANMLVPVSLVASSDGPLDPIANVTQSRVMSEGVAAVIDYLVRDNSGQARKMRAPIAVMDFGGSTFEVVTVMPNMNIRHSSSDTMKRGTYDIRTSFAPMLADYLRELGFKMKHAADWMVTEAFETGSIEFPGVGIDAGNRVIPVKHIIEEAAKPIVNEIKKFTQAKLPNMAEYEAILLVGGGGLLTESLFEDWKEEFGLIVVDEYANARGMLKVALIA

SEQ ID NO: 117 - protein, 350 aa, Leptospirillum sp.
MSKTKPVRSPEQEFSEEPVIDVGLDDGYAAIKLAWYGPDGTLRTHSVPSRARSGSLGVGSLFGDSALSVGGYETEGERFTVSPGLEGEVTRFPDYNLSPLARVLAHHALIAAGFAGKQVRIASGLPLDRYFRDGKEGKRKDEHRIARKIESFARPVRRLDGTGTARIVSHSVFAQGLAAVVDWLVEGTTIRSQKDPVGVVDIGGQTTDISVINPDFQANHGHLKTCDLGVLDVRDLLGRRIQSSHDVDKISDSALDAALTTGATRIWGKDVSVQDELRDAIREIESRLANEILSVFGKEASTLETILFVGGGSLVFRNLPTRFPNAAVVDCPEFANARGLLKALSLSGRS

SEQ ID NO: 118 - protein, 293 aa, Heliobacterium modesticaldum
MIKLGVDNGNYNTKSSEGMLYASGYTASDKEFITPDMQLFYEGRYYAIGERRMRFQQDKTREPDTFMLTLPAIADAMKHAGTTSAEIALGVGLPIGSYGTQKEAFRRYFLRDNVSFLFEGTSYRCRIAECKVFAQGHAALCRYYPQLKDYRSITLVDIGGYTVDILTLHDFRLDRSSCASLRMGTITLYSRIQDTLQRNDILLSDELITDAIRGDIQHADSKLIHAVVEQAVVAYCKELLNALRERGLDLRLPTVFAGGGAELLELMLRRSDINTVAVLNRFANADGYKLLMG

SEQ ID NO: 119 - protein, 293 aa, Desulfitobacterium hafniense
MIKLGVDNGNYNTKSSEGMLYASGFSVSDKEFVTPEMQVYFEGKYYAVGERRMRFQQDKTKEQDAFILTLPAIADAMKKAGMTYGEINLGVGLPIDSYGMQKDAFRRYFLRDNLSFRFEGEFYRCRIVECKVFAQGHAALCRYYSQLKNYRSITLVDIGGYTVDILTLHDFRLDRSSCASLRMGTITLYSRIQDTLQRSGIILSDELITDAIRGESQHADSKLIGAVVEQAVAAYCKELFNALRERGLDLRLPTVFAGGGAELLKPMLYRDDLNAVAVLDRFANADGYKLLMG

SEQ ID NO: 120 - protein, 322 aa, Syntrophus aciditrophicus
MQMNLGLDVGYGDVKAVYQREGILEMLKFPTAIAYAEREVGDLSAFAGGEEYEYRGRKYFVGREALVGAFSTRSFEFMKRYSPLFVFKAVKKIHRRTGELVTDVAMGLPLSHYTEANLKELVPLLQRIEVGREVLELNARFYPQGLGVLADYRLSQAGDVNARTDRDMIILDIGFNTVDVIVVERGRIVKGESDTLERHGVSKISLDLAREIKVRMQLDLSEQESKDVLRQGRIRVYGAERDLAELVRESAEKYMDWLIQEVHSKWMARIQRAEKVIIAGGGAYYLQEHIPEEYLPLVHVPDHPEYANARGFLKALDVESGK

SEQ ID NO: 121 - protein, 340 aa, Burkholderia vietnamiensis
MQNQTIIGLDVGRSAVKATAFASGMFYPLTFPSIVSPAIDLTDESTARKAEAETIVVAGRRYFTGDTARLQGSAGTTVGLSHNWTSTPEYLALVGSTMKRFAAKGVPGLTDPLLVIGTPASLYGSQQEQLKAETLKIVQAEIRVLPQPMGAYCDFYLDKSGVPVKTHMQDDAGRKKSWAVIEVGHFTTDFLLMLEGQYIERGASSCEGLNFAAEHLLRILNAKDIHSNLIECELAIRTKTILQYGRDVDIAEEVAEAVSHVAQKIISKADSLLSTDVRKLHGVLLAGGGAPLLYDELSKKWPHCMLLDNPRMAVANGFCRYGMGIALRRAMRSQQESVNV

SEQ ID NO: 122 - protein, 348 aa, Clostridium novyi
MSKGNNIVDSFSVQVIDDGYADTKSRGEDTNMIVTPSYVTSWRPSYNKDNDLQEEKIDKLSRIEVKVNGSKYLVGQCAVKQDRNIQWNGAADKHDDTSFDILLKTHLSLLNKKPMSRVKLVMGLPVSASLDKERIEKMKAKVLRQHNSALRLYGDKDFQNKIVKVEDLIIKAQPHGTLCDLILDSSGNLTNKDLARKVNAISDIGGKTHNLYLVDALEPLSDFCDTKNSGMYIAYMWIKNYIEQELHLNVSDGQIQYIVASGQIKGYDLTPVIQKAYRSLARKIILEIRTVWENAFPFIDNIIFTGGGATVLKPYLQEEFKNAMYLTRNQNASGLFKQGIRKWKRKAV

SEQ ID NO: 123 - protein, 348 aa, Clostridium botulinum
MSKGNNIVDSFSVQVIDDGYADTKSRGEDTNMIVTPSYVTSWRPSYNKDNDLQEEKIDKLSRIEVKVNGSKYLVGKCAVKQDRNIQWNGASDKHDDTSFDILLKTHLSLLTKKPISRVKLVMGLPVTASLDKERIEKMKAKVLRQHNLGVRLYGEKEFQNKIVKVEDLIVKAQPHGTLCDLILDSSGNLTNKDLARKVNAISDIGGKTHNLYLVDALEPLADFCDTKNSGMYIAYMWIKNYIEQELHLNVSDGQIQYIVASGQIKGYDLTPVIQKAYRSLARKIVLEIRTVWENAFPFIDNIIFTGGGATILKPYLQEEFKNAMYLTRNQNASGLFKQGIRKWKRKAV

SEQ ID NO: 124 - protein, 297 aa, Clostridium beijerinckii
MRISADIGYNTTNFIGHNIEGSFSSTVKEKMHELETAKYTVEYNNKTYLIGNDDGFTSIEHSRDKDIIFHICLYTAIAATMSSTIDNNVRVITGLPAQFFAEQKNSLIKALENRRVFMKLNGENRSFTITKVIVFPQSAGLFLYDKSLVEKDTLVVDIGGGTLDIAYMSNGQFKEGRTYPLGVNPTYDVLLQELTKYGVNYSNRMKAEQIIADKAIFVEGKEIDVSKDIDNVLSLRAGEIINAIKQAFPEQSKYSRFVFIGGGALLLKNYLKDYRVLDDAQMINVKTYDIIGKSKNV

SEQ ID NO: 125 - protein, 348 aa, Moorella thermoacetica
MLAIQTNPQPAALAIDVGFGYTKAVSSTGGKVIFPSVVAPAGSPDAFDRLDKSDTGYRVRIKKGIDGLLEEWLVGELALKEGREVQYFQDWEKHSHPAHDAVLLAAAVLTWNWPRAGSGIMGISNPALVVGLPVDVWRDELQREGLKKHLAGLAAEVSVNGNDPVRVTFSRVYVYPQAAGAFLTVPDLPDSGIVALVDVGQKTTDSAAIEIVNGRQRLVKTMCFSINKGMAALVEAVREEFRRQTGAPLPPQQAWETVKSGSLWYRGKQIDMAPAIKKARSEIARAIADQVLAGWGERADFVRKVYLAGGGILDLPDLKNMFPAAAVLPGPQWANALGFLKVARGLAV

SEQ ID NO: 126 - protein, 316 aa, Desulfotomaculum reducens
MSKVVAIDFGYREIKGVNSEGLEIKFPTAMAPYVKHPTAEGLEEVVTVTKPGYEPEMYFYGQKALDETGVGFTNDRDKHLHSGHDILMLAAARKLGYENGDTLVVGVPISYADQREALKTQLERLHGDVSVDGGKPKRISFNDVLVLRQGIVVFGLIPDLPNGTLISFDIGEHTTDVSTVKFKNGVIEPNPSKCFSLEYGYSKVVEAIQKEFQSKAGSPVSGEQARAIAEEGYVIYKLKKLDMTLEVLRAKEEIAKNIVKDAKKRLGEIADFAAGFYLCGGGADVLPLKELLPGAVIVDNPQTANARAYLQLAMSE

SEQ ID NO: 127 - protein, 369 aa, Heliobacterium modesticaldum
MNMHAARLRQLPGFEPGEGKNLTVGLDIGFGYVKVVAGNGRWALFPSIVGEGRELHILSGFGSNDPIDNLVVDVDGRRYFVGNLALRETEAELDIDPDKIFNIDFEVLVYTALALVSDKSDQDVNIYLGLPINFYRTQKARFEDKLRAHQMSRFVKILGQDVRLIRIGNFEIFPQAGGAIFNQILDFRSEVRTPRLARGKIGIIDGGTKTTDCIYMEDLKFVDQRSFSVNDGGTHKILMDIRDFLMKNFDHYYPRLAEVDQMLRERKVEVKGKVYDLSSVIDASASRVARKIVREIAAKWPNHMEFRAMILVGGGGYVMHPFLKEIFPDILLVQDEFEGEAVTGGWNVIQFANALGFLKLAVMRYGEKK

SEQ ID NO: 128 - protein, 310 aa, Clostridium leptum
MNKTMNIGIDHGYYAIKTRHFSFPAGISEYSHEPYTLQNTLEYGGKFFVCGTGRQPILRNKMENENYYLLTLAAIAKEIQQRGAKTECSVTIAAGLPLAGFGREKKSFREYLRPSSQPVSFQFEGIPYKVTIEDVKLFPQGYSALMIHPELLQNEPSVLLMDIGGWTVDLMRLDNNVPNAATCRSLELGMIRCIDEVKEQVRRDVGLSVTDAQVERVLAGKPCSMDEDARGIIQKQGRLYTERLLSAAMEAGFDLKAIPVVMLGGGAAVVKRNVAPQDGLCRVFALLDDRVNAEGFERILGRLSGGVGKG

SEQ ID NO: 129 - protein, 301 aa, Clostridium difficile
MSKLGIDIGNYAVKTSTDDIFESKVTEVKNFGSDSDSIKIGNKTYYLGEGDEEINIVKYEKENFLPLLLGAICRNTDDEVIDLALGLPVKQFGGLRKDLIEKLQGKEYHVEFEKGNETTKRDITIRSVQVFPEGVTGYLYYAKDIVDQIAGRDVVLVDIGGKTTDIALVQGNKATDPYSVNVGTINIYDAIKKSLEMDERFLGKVEIKREKIQDYIDKGFYLNGEKQDIKKNIDASVGLFKQIYNELKLNYPISTSAVVVMGGGAKLLGEAFKKNIPGIIVMSDVDKHVFANAKGYKKMMK

SEQ ID NO: 130 - protein, 303 aa, Clostridium perfringens
MKIIGLDIGNAEVNTSEGVHFPSRVKIGVNNMNKDDIKVNFEGLDFTIGQGSNNIGLNKYKNINFKISVLVGIAKSFKENDIECNVVIGCPIETFNKNKEIVKDIKGIIESWGKQTIVIEQGESKEIKVIDIKNVAIFCESGIVFKNRERFSKEKTLVVDIGGGTRDDSLWNGLDLVECKSNDKMGMINLYETIIKEVNRRNKSNLNFDDAKAMIGKKEYKINQEIVDISYIDIIIENFVTGFMSEINQIFPFSNVDSIQFVGGGAILLKEYITRLIPKAEVPNNAEFLNAETYREVGELMWS

SEQ ID NO: 131 - protein, 389 aa, Bacillus anthracis
MSILLKAGADAGNNGLKLMVKGQDPIFIPSIYALYIGEPTGLLDEGDVSLSELENHIDVTISSPSLMLNNVRYIVGEKVIQDQLKGTEVEKKSNKSTDELMVITILSGLAVSAMRQSPTSSHINIRYDLSVALPMQLITQEIAAENAKRYMGNHKVVFHYPNGRDVTINISIEYCKCLPEGASGTWGIVYDEEGNVVKHKIECEQNKVSEIDFVDKTLLSFDIGAGTTEEVVSLGVNFRPQLSKGLSYGVKETLLQIITRWNRKYPTKTIDSITEFNQIYLNDKHPRNALLVEESQPALLGLAARVATDIINKIDDMKDDPYVFIYGGGAVIIKNSLKMILKQKGRLTNVIFVDNPLFTNARGLLVYTCSPKYREHKQKELGFTNLTIS

SEQ ID NO: 132 - protein, 385 aa, Bacillus cereus
MAILKAGADAGNSGLKLNVLGLDPLFIPSIYSHHIGEATNILSDEDISIEELENNIDVTISSPTLKANNMRYIIGQKVIDENIKGIEMEKKSDKSKDDLVLLVTLAGLAISAMKKHPNKNKIDVTYDLSVALPVATITPQTAQGFVERYMNHHTVKFHHPSGREVVVNIQVEFCKCLPEGAAGSWGIVYDEKGKTIKRKVETTEDKTTEIDFVDKTILSFDIGAGTTEEVVSHGVSFKHKMSRGLPYGVKETLLDIIKVWNLNNKQKTIDSIAEFNAIYLDSEHPRHIRLKEASRGALLGLANRIATDIINKIDDMKDDPYVFIYGGGAAIVKESLQQILEQKGRLTNVIFLKDPLFVNARGLLVYTCSPRFEELKEKALAPVGE

SEQ ID NO: 133 - protein, 407 aa, Bacillus cereus
MSNVKEKEDFLREDEELEMLTKAYKMDSAFDVGNANVKAKINGKVLKQPSVIQYLLQQPPVTETNLTKLVSNLEDELTVHITSNAIKRSGLYNIGKRATITSDANVENMNIKLGNKYKHTIPVVMTLGMMACESVKQAFSEESKLPSTINIKSKLSTAIPMSEYTVDKAKFLEDRFTNNKHIVIVYVGGESVTVSITFEKVKVTKEGVPPLYALIEGEQAILDIYNEQYQEKAVPKDFVNKKILHADIGDGTTEYVYTVGLNPVPDNCTGERRGVGHATESAIALLKEDTNGRVLLKRQQYMNILKDPSHRLFDEASRFLENGKYIQAMRILEDIQEKYTEKIAGDADIICVYGGGSIEFESLLYDDLLEFCEEVNCKLLWIPEKYAVDMNMEGLDILNKKVFFKKG

SEQ ID NO: 134 - protein, 383 aa, Geobacillus stearothermophilus
MKLVVANDIGNSETKMIVNDTLIKQPSVVKRLLSKPNVMETNVEKNIANLLDELIVHVTSNAMKRSGLYFIGKRANMTADKVENMNIKLGNKSKHDIPVLMTLSMLAARSVQLAYQENQELPSSISVDVSMTTAIPASEYSADQARYLEGRFTSNDHVVIVYVGETPVTVTLHFQTVKVTQEGIPALYALLESENEILKNYNEHYKKQAVPKDFANKRILHVDIGDGTTEYIYTVGMNPVTDVCSGEKRGVGHATEEATQLLKEEVGGFLNLNRQQFMDIFRDPSHNLHDLAVRFMQEARYSQAQRILEDIQEKYSDIAGNVDVIAVYGGGSIQFKEELYEELLDFANTVHCEVLWIPEKYAVDMNVNGLHVINEKILFKQHA

SEQ ID NO: 135 - protein, 381 aa, Oceanobacillus iheyensis
MCIYFKVGNDNGNSEHDIIINDKLIAQPNVYSKVRKLPNLDEVNKEYVLEHIEDNLIVTCEDPSGIYYIGNYALSSGQKIRNVEVGIDNNKLESEVIVINTLAQIAGQAVKEYYLKNKSFGDIIKVKVDMATALPISSYSNKNAKLFSEKFTNKKHFITVHIGNEVARVEIEFEFVMVIPEGVTSSFLFIQTDDALKKYNFKKEFFKNAKVLHVAIGEGTVEYPITKGIEFNPNFIKGSNNGVGHAIDMALDEFKETKGLIKFSRQDYSEVLKNKKHKYNELAEDIIEQYIEEQAEEIFHNATKEIQKANNDIDVVCIYGGGSILMRSALEEKFKKFCDRADIKLLYFDKEDCVTLESLGLNVLVNSKLFKTLKQNSTVKN

SEQ ID NO: 136 - protein, 395 aa, Clostridium perfringens
MVDLKNPRIAAVDVGNDSLKALFGKLDYELNIPNVIARDVADRPVIGIEELDSKEPLDGIHVKVHSPALKDNNAIYRVGTLATKSDNASELDPGSSKSEEDQTLVMLFVSLALDAVREENAGLFPKNNNIIDTNYILGTGLPLREVKEGKDAGYRSKLLGSVHQVEFLVTPKYQGIKVNLKFSDVKVYPEGFAAFINLVMDNDLNIINKELIDKRILIQDIGGLSTDIAVIKNRTVDDDKAQGFNLGVSESLEMIREEIRSKHGVELDSRRDVVEIITKKNDRNHIMVKGSRTSVHDITDRILFDLAKKQYRLLRNVWQKNSQTEICYFVGGGSAVLKEYIKSLNNSLDGYNIDFFEDEKESIWMMANAYYKLVADHLKRTSKPDKQDEKKPVKA

SEQ ID NO: 137 - protein, 383 aa, Bacillus sp.
MKLVVANDIGNSETKMIVNNTLIKQPSVVKRLLSKPNVMETNVEKNIANLLDELIVHVTSNAIKRSGLYFIGKRANMTADKVENMNIKLGNKSKHDIPVLMTLSMLAARSVQLAYQENQELPPSISVDVSMTTAIPASEYSADQARYLEGRFTSNDHVVIVYVGETPVTVTLHFQTVKVTQEGIPALYALLESENEILKNYNEHYKKQAVPKDFANKRILHVDIGDGTTEYIYTVGMNPVTDVCSGEKRGVGHATEEATQLLKEEVGGFLNLNRQQFMDIFRDPSHNLHDLAVRFMQEARYSQAQRILEDIQEKYSDIAGNVDVIAVYGGGSIQFKEELYEELLDFANTVHCEVLWIPEKYAVDMNVNGLHVINEKILFKQHA

SEQ ID NO: 138 - protein, 379 aa, Geobacillus thermodenitrificans
MCIYFKVGNDNGNSEHDIIINDVLISQPNVYSKVRRLPNLDEVNKQYVIENIENNLIVTCEDPSGIYYVGNYALSSGQKIRNVEVGIDNNKIESDVILINTLAQIAGQAVKEYYLKNKSFEEIIKVKVDMATALPISSYSNKNAKLFSEKFTNKKHFITVHIGNEIARVEIEFEFVMVIPEGVTSSFLFTQTDDILKKYNFKKEFFKDAKVLHVAIGEGTVEYPITKGIEFNPNFIKGSNNGVGHAIDMALDEFKETKGLIKFSRQDYSEVLKNKKHKYNELAEDIIEQYIEEQAEEIFHNATKEIQKANNDIDVVCVYGGGSILMRSALEEKFKKFCDRADIKLLYFDNEDCVTLESLGLNVLVNSKLFKTLKQNSAV

SEQ ID NO: 139 - protein, 395 aa, Clostridium perfringens
MASLKGKTLHIDIEGDIGNDSFKGYINGEYIKMKNVYQSVYSMPNVTETNIQKNVVNLVDNMFVNIASKSIRRSGMYFIGNRAMLTGKNPKNMNIKVGQKYNDDLPLINMLGLIANKSVQLEWERTEQLPQSINVTVDLISAIPASQWTPVNAKHLEQRFTNSNHVVVVYVGEEQVTVSLTFNSANITQEGVPPLFAILEGEEEMFTDFTKLYAKKLEIKKIDGAFFKNKKILHSDIGDGTTEYIYTVGVNPVIDACSGERRGVGHATEEAVKLLNQERGTNIKRQQFSQILQDIDHKYHEEATTHFNITKVEQAELILEDTDEKYVNNTASEAEVLCVYGGGSITFKDELYNQLLEYCERVGMYLLWIPEKYAVDMNAKGMQIIKKILSRKKVK

SEQ ID NO: 140 - protein, 400 aa, Bacillus thuringiensis
MAEKNLVSEVKEVESVVEKKVVAEADLGNSNLKIFINDKYLSVPNVFQRVHGGVDSYETDEQKNVINLLDDLHVHVTSEAIERNGSFFVGKRAMRNSEKMKSMNIKVANKHEEDLPVINTLSVIAANVIQSVYEEAKSVPDLLKVELDLMTAIPASQHNPKTAEILSERFSSNTHVVIVYVGKKAVTVQIECSRVRVTKEALAALYAITEGPDEMFEEFQELYAEQLNNEKITGKFFKDKKILHGDIGEGTSEYIFTDGLSPVLDSCSGARRGIGHAIEEACNLLNKDRKTNFKRQQFTEIMLDKNDKYNEDATEFIYETRYEQAELIKEDLEQKFINDTGGRAEILAVYGGGSIALKNELFNKLKKFCETTGMMLLYVPEKYAIELNPKGMNVLRKIID

SEQ ID NO: 141 - protein, 399 aa, Bacillus cereus
MAEKNLVSEVKEVESVVEKKVVAEADLGNSNLKIFINDKYLSVPNVFQRVHGGVDSYETDEQKNVINLLDDLHVHVTSEAIERNGSFFVGKRAMRNSEKMKSMNIKVANKHEEDLPVINTLSVIAANVIQSVYEEAKSVPDLLKVELDLMTAIPASQHNPKTAEILSERFSSNTHVVIVYVGKKAVTVQIECSRVRVTKEALAALYAITEGPDEMFEEFQELYAEQLNNEKITGKFFKDKKILHGDIGEGTSEYIFTDGLSPVLDSCSGARRGIGHAIEEACNLLNKDRKTNFKRQQFTEIMLDKNDKYNEDATEFIYETRYEQAELIKEDLEQKFINDTGGRAEILAVYGGGSIALKNELFNKLKKFCETTGMMLLYVPEKYAIELNPKGMNVLRKII

SEQ ID NO: 142 - protein, 428 aa, Clostridium perfringens
MTVKEEKIMKMSNDNGNGDSKIIVNGALTIQPNIIHKKGFETPETGGWNISKIKNLKNNLIIGVFEKPEINFFDEEDTEEEVESIYFIGSYALQSGLKTVGLNIDVDEDKMKNPITVISTLGYAAAQAVKERVLDLEKSLGRPFAIEDIDSIGDLDLKVDLTTSLPARIYSLDKADTLASKFKNKEFKLKIYVPNNKFVNVKIKFNNVGVVSEGVTTVYYLANIKNNIFDEFNKNNDDVKIDNEFFRNPNNTILHVAIGAGTTEYPRTNGYDWDDVYKTGSKNGTGHAIKDALKVLDKIDGTQNIRNPKAIERILKNKGKEKDGTKNLFYNEIKKSLTMPLMTQVDEIMDHIIEELNRGPQISLVVIYGGGSILMKPILKKRIMELQETRRLKFLYIPEEYAVNLEAYGLYTLVSSPDFAGNSSLRSK

SEQ ID NO: 143 - protein, 389 aa, Bacillus cereus
MSILLKAGADAGNNGLKLMVKGQDPIFIPSIYSLYIGEPTGLLDEVDVSLSELENHIDVTISSPSLMLNNVRYIVGEKVIQDQLKGTEVEKKSNKSTDELMVITILSGLAVSAMRQSPTSSHINIRYDLSVALPMQLITQEIAAENAKRYMGNHKVIFHYPNGRDVTINVSIEYCKCLPEGASGTWGIVYDEEGNVVKHKIECEQNQVSEIDFVDKTLLSFDIGAGTTEEVVSLGVNFRPQLSKGLSYGVKETLLQIITRWNRKYPTKTIDSITEFNQIYLNDKHPRNTLLVEESQPALLGLAARVATDIINKIDDMKDDPYVFIYGGGAVIIKNSLKMILKQKGRLKNVIFVDNPLFTNARGLLVYTCSPKYREHKQKELGFTNLTIS

SEQ ID NO: 144 - protein, 389 aa, Bacillus cereus
MSILLKAGADAGNNGLKLMVKGQDPIFIPSIYSLYIGEPTGLLDEVDVSLSELENHIDVTISSPSLMLNNVRYIVGEKVIQDQLKGTEVEKKSNKSTDELMVITILSGLAVSAMRQSPTSSHINIRYDLSVALPMQLITQEIAAGNAKRYMGNHKVIFHYPNGRDVTINVSIEYCKCLPEGASGTWGIVYDEEGNVVKHKIECEQNQVSEIDFVDKTLLSFDIGAGTTEEVVSLGVNFRPQLSKGLSYGVKETLLQIITRWNRKYPTKTIDSITEFNQIYLNDKHPRNTLLVEESQPALLGLAARVATDIINKIDDMKDDPYVFIYGGGAVIIKNSLKMILKQKGRLKNVIFVDNPLFTNARGLLVYTCSPKYREHKQKELGFTNLTIS

SEQ ID NO: 145 - protein, 389 aa, Bacillus cereus
MSILLKAGADAGNNGLKLMVKGQDPIFIPSIYALYIGEPTGLLDEEDVSLSELENHIDVTISSPSLMLNNVRYIVGEKVIQDQLKGTEVEKKSNKSTDELMVITILSGLAVSAMRQSPTSSHISIRYDLSVALPMQLITQEIAAENAKRYMGNHKVVFHYPNGRDVTINISIEYCKCLPEGASGTWGIVYDEEGNVVKHKIECEQNKVSEIDFVDKTLLSFDIGAGTTEEVVSLGVNFRPQLSKGLSYGVKETLLQIITRWNRKYPTKTIDSITEFNQIYLNDKHPRNALLVEESQPALLGLAARVATDIINKIDDMKDDPYVFIYGGGAVIIKNSLKMILKQKGRLTNVIFVDNPLFTNARGLLVYTCSPKYREHKQKELGFTNLTIS

SEQ ID NO: 146 - protein, 469 aa, Corynebacterium glutamicum
MTSAVNVQKKTTQKVLKPINTKNYSATDAVQTGQHGSALGSNIGVYTYTAGLDIGNGYVKGIIEATGDTTGTSVDVIDMPSAATRMSRPTEVPEPDDTAVAVTGADFFNHIDTNFNSPMVKGNYRYLCGTRSLSARGSLEEFDLVGNRSKAEQELSKVLVMAVLAAKAVKDFVAAHGRIPQVAVEGDPGVLRVHTYLALALPINEYVGHRHGYKAQFMGDGAANPAVHVVTVNNFETPATVQLIFERVEVIAEGASAQYAITAGGEVLMNGMLADVRSKGLALEGVTAGDVLQARHTIGVDVGEGTVNFPVFTDGRFNHDASRAYDKGYGTVLESAIQAMDDAGLAHNFNSRKQLADYLQRPPSALKRNFYTRVEQHVDQEAVFFVQDVAAEFARVLSDVGALTEVAFVYGGGSGPLRDRLHEALLIKAAEMGSEDTFPVLYLDSAYSRKLNREGLMIAARSIAAKARK

SEQ ID NO: 147 - protein, 409 aa, Lactobacillus salivarius
MSKNNILKLNVANDLGYGSVKAKVEDTNIHFPSVIAIQREQDLNKPVEFNSNQEKLTYLEGMINHMDVTISSSAVKTQGRFLVGNAAIKSSLPLKAFDVNDFTGKSDNDLAIILTLSMIAAQRISLAVKNGEDLSDQLSTEINMTTALPVSEGKKNGIINNYVNKYISSKHTVVFHNFKDPITVSLNFKNVYVALEGEVAQLYLKNSDIKLQGLIKQDFSKNYPELANDIKVSDLVKIDNLLGIDIGEGTTDLVVIKEGHANAVASTSLPTGYGNALQDAIDVLQTENMNFEARSQLQDYLAQEVSPLAKRMQTKVRQIVFEQLEPFADKIVTAASKTMRKAGANVEILYVYGGGSIPMLEQTALRQKLSQKMKDFSGGIDVPVIWINKSYAQNLNEKGLELILKAMNK

SEQ ID NO: 148 - protein, 324 aa, Vibrio cholerae; identical to SEQ ID NO: 31

SEQ ID NO: 149 - protein, 275 aa, Bacillus anthracis; identical to SEQ ID NO: 50

SEQ ID NO: 150 - protein, 364 aa, Trichodesmium erythraeum; identical to SEQ ID NO: 64

SEQ ID NO: 151 - protein, 310 aa, Nostoc punctiforme
MINIYCADIGNYSSITALKGEKPRVMRSVFQDVTYTSARDLDTDNSPSIKLDDKVLVLGDRATKQKNSQTAAERGKDLPEFFKPFTLAGLRQDFDGVVRFLVPEHSQWHEDTIRRTLVAEHQINVNGTNYRHRIKNVEFFLETDVAVINAYRNGKLDMDGDTLAIDIGGGTTNYVVITPSSEVLTRRSIPKVGGVSLANDIINSDLMQSYAKRDNVAFKVAKMMDAIADGSFTYGRKYDFSSVFPGLLENWFNNLMDSISTAANDYLADVTNVMLIGGCANLVRQKLSAKQGFYIPANPQLSNIQALLAM

SEQ ID NO: 152 - protein, 389 aa, Nostoc punctiforme; identical to SEQ ID NO: 65

SEQ ID NO: 153 - protein, 389 aa, Bacillus anthracis; identical to SEQ ID NO: 131

SEQ ID NO: 154 - protein, 355 aa, Shewanella sp.; identical to SEQ ID NO: 92

SEQ ID NO: 155 - protein, 353 aa, Burkholderia vietnamiensis; identical to SEQ ID NO: 99

SEQ ID NO: 156 - protein, 340 aa, Burkholderia vietnamiensis; identical to SEQ ID NO: 121

SEQ ID NO: 157 - protein, 340 aa, Bacillus cereus
MKSLYAIDVGIGFTKRAYRQDVDSEVTIKSEASTLAPIPNHAESEDLTKVSFIDLDFAYYMGNEAHQSDASFLPPFDEEIENYYESEQFKQQIFGCIAKDYKENVVLPLVVTGLPVTDFGSQHEQLQRALKKETSVQIDGKFITITVENVLILQQPVALHAYFLKEGIIQEQDRILIIDGGFRTLEMTDMKQNVILNHYETELGCSKPLKNIKNILQNHAGESNQLHINDMPNILEKGYGGREENPQTSQVHTLIQKELDAHFQDVMRVLQEQFKLEQYDTIIWTGGIVDLHKKRIEKIQGEISSFRMVDASKEAALHGYYMIGSQVFDDITNQSVYESK

SEQ ID NO: 158 - protein, 337 aa, Methylibium petroleiphilum
MLTKTIIGLDVGRSAVKVVAFANGLYYRLTFPSLVSPAFPINDEGTAARAELETVEVLGKRYFTGDTARLQGGVNMSVGLSHDWTNGPEYLALVASTMKRLAALGVPGLDSPYIVLGTPASLFGRQKEALAQRTQAVVAAEMKVLPQPMGAYCNFFMDARGVPIKDRQKRPDGKNRSWAVVEVGHYTTDFLLMREGNYIERAAVSCEGVHFAAENLVRILAAKDIQATPLTAEEALRTGVIVDFGERRIEAQVAEAVDHVVQKIMTMADSVLSNDVRSLDGVLLAGGGAPILAAGLQKKWPHTVLLENPRMAVADGFCRYGVGQMLRRAMAAEKATA

SEQ ID NO: 159 - protein, 305 aa, Campylobacter upsaliensis
MANEIQKIAIDIGYGDTKVAVGKEVFKFASAISKQKEAQSEYFEGKNEGVYDFLGKKYFVGDNALFEAVSTRGFDFLVKYSPLLVYHAIKKANFDLSKDIHIFTGLSIVNWGEKERFLESLKSIKVDNDILSPKITLMAQGQGVFCDYEKEKEGLVCVVDIGYNTFDFLVFDNGNPRQDLSFATKKGANVIITELQNIIKKRYSLDISEQSSKDIFQNGFIEIYGEKIDLSDSIDDLKEEYSEFIINELRNQREDIVKTAKRVIFSGGGAYFLDNVKSLKNVKNVDFSDKPYEYANVKGYLKWKK

SEQ ID NO: 160 - protein, 305 aa, Burkholderia vietnamiensis; identical to SEQ ID NO: 88

SEQ ID NO: 161 - protein, 341 aa, Bacillus thuringiensis; identical to SEQ ID NO: 49

SEQ ID NO: 162 - protein, 388 aa, Bacillus thuringiensis; identical to SEQ ID NO: 2

SEQ ID NO: 163 - protein, 230 aa, Bacillus thuringiensis
MAYTGVLLSKTRRQPRPNKIFMQKAKVMVLDIGAGTTDLIVIDQGKAIERSKYTIDLGGNNITQTLRTTVQTNLEIRLSAQVFEQGVITGKVKQGLKEHDVTDELIGAKRSVAAKISKEVKDYLESSGIEANSIEYILVVGGGSIPSENDKVKPISDYLLDSIKRFAPQVGLVDISDIITKPNSVAFENVADADFVSSRELNISGAGTVTDLLEIKQYLAQQEQAKQVQA

SEQ ID NO: 164 - protein, 342 aa, Thermoanaerobacter pseudethanolicus; identical to SEQ ID NO: 60

SEQ ID NO: 165 - protein, 345 aa, Thermoanaerobacter pseudethanolicus; identical to SEQ ID NO: 58

SEQ ID NO: 166 - protein, 346 aa, Marinobacter aquaeolei; identical to SEQ ID NO: 115

SEQ ID NO: 167 - protein, 316 aa, Caldicellulosiruptor saccharolyticus; identical to SEQ ID NO: 110

SEQ ID NO: 168 - protein, 236 aa, Caldicellulosiruptor saccharolyticus; identical to SEQ ID NO: 111

SEQ ID NO: 169 - protein, 324 aa, Shewanella sp.; identical to SEQ ID NO: 28

SEQ ID NO: 170 - protein, 297 aa, Clostridium beijerinckii; identical to SEQ ID NO: 124

SEQ ID NO: 171 - protein, 348 aa, Polaromonas naphthalenivorans
MKPSILAIDIGFGNTKATWSHRTLAGKAEAWSEIIFKSVCPLALDDDIAPGQATSNLDRVAVSVAGQAYYVGPKADREGGLRALHPDYINTPTHEALLLGAWHYMFKETGIVSPSVDMLVLGLPVSGFSANKKVLKEIGSRVRRVPVPMPMRSRLGKAYVDVSAKQVVVLPQPLGGLRLAAQSALELADDGVISMVIDPGYLTFDWLLSDGMAPHYELCGSFQGGVSQLINAVAKRLSQDHGIESADFAMIESALAKGELLLDLKRIDMTPYRKLAGQQAQDMVAQWLMRFNPYKAGVSRIFVCGGGAGFYIDALKARLPHIRMDVMPEGVMSNCRGYFLTGQDMFAD

SEQ ID NO: 172 - protein, 364 aa, Congregibacter litoralis
MTERIDKKPTQADKTSQLTSDPMSVVQVGLDDGYAYTKVALADGRLFSAPSRARIGSAGVTWIREQEQRIFEYETGGTVYSVGAVDGEATQFDEYPSSALNRVIVQHAFQQAGLSGRSIHLVTGLPVSAYYRHDGQLRQQEIDRKCESLKLSVEPKPNSAKPGKSILSASVAFHEVIPEALAAWYDHVIVTQADGVTLDGDRLSAPIAIVDIGGRTTDFVVVQDQGIVHGSSGSLNRGMLNVKSRVADLIQQTFDMSELGEQSIARAVDSSRLRLHGKDHDISAMVAAAKRELVELLYAETRRKLGLGVELDQVLFVGGGSAALATDIANWFPNQTIPDHAAFANARGMLKYLQYVCDDTAGGF

SEQ ID NO: 173 - protein, 333 aa, Congregibacter litoralis; identical to SEQ ID NO: 112

SEQ ID NO: 174 - protein, 316 aa, Desulfotomaculum reducens; identical to SEQ ID NO: 126

SEQ ID NO: 175 - protein, 384 aa, Halorhodospira halophila; identical to SEQ ID NO: 56

SEQ ID NO: 176 - protein, 395 aa, Bacillus sp.; identical to SEQ ID NO: 136

SEQ ID NO: 177 - protein, 327 aa, Photobacterium damselae; identical to SEQ ID NO: 27

SEQ ID NO: 178 - protein, 344 aa, Bacillus weihenstephanensis; identical to SEQ ID NO: 90

SEQ ID NO: 179 - protein, 341 aa, Bacillus weihenstephanensis; identical to SEQ ID NO: 44

SEQ ID NO: 180 - protein, 318 aa, Nostoc sp.; identical to SEQ ID NO: 67

SEQ ID NO: 181 - protein, 310 aa, Nostoc sp.
MINIYCADIGNYSSITALKGEKPRVMRSVIQDVTYTSARDYDSDNSPSVKLDDKVLVLGDRATKQKNSQTAAERGKDLPEFFKPFTLAGLRQDFDGIVRFLVPEHSQWHEDTIRRTLVADHQITVNGTNYRHRIKNVEFFLETDVAVVNAYRNGKLDMDGDTLAIDIGGGTTNYVVITPSLDVLTRRSIPKVGGVSLANDIINSDLMQSFAKRDNVAFKVAKMMDAIADASFIYGRKYDFSSVFPGLLENWFNNLMDSISTAANDYLADITNVMLIGGCANLVRQKLSSKQGFYIPANPQLSNIQALLAM

SEQ ID NO: 182 - protein, 350 aa, Nostoc sp.
MTDLAEMPENALPRHQGTLTLIAGYDLGNSGVKFVTSDRKIRFPSYLENCYYRPTELPTEGYVEYLEGDAITKLDYKQWLSGYAAYDANPKNHLRVTDDATAKVTQSLKHLLAALSNYPYKPVINLIICASLHERGDLEEQLIDAIAGKHIVKFGGKPIPTTVNIHVLKVYDEGHAAIAANAHTLDTSKQNVIVDIGNRTVIATLIGQKGHLANRKTFDNGVEELIRMISVNPTFKNRLYGEIAIPHLIRQGLESSEKPFWYGKQFSFEDVYRQELMPWVQKSLAPVFKFIHPWKINADACLIIGGGSQLPSVDEALKAKGFVIAENPLWANAEGLYQLATMMYSRGIDE

SEQ ID NO: 183 - protein, 390 aa, Oceanobacillus iheyensis
MTKSRIAAVDVGNDALKGNYGKLENELYIPNVIAPDLEERPVIGIEELDDKEILENIHIRIHSPALSENNLIYRVGSLATKTTNSQELDQGSSKSEEDQTLIMLLTSLALDAVSASDFEEKNGVIDANYTLGTGLPLREVKEGKDVAYRSHLLSSVHQIEFLVTPKYQGKKVNIKFDEVKVYPEGFAAYVNLIMDNDLKVINKDIIDKQILIQDIGGLSTDIAVIRNRNVDDDKAQGFNLGVSESLEQIREEIRTKHGVELDSRRDVVDIITRKNDRNHIMVKGSRTNVHDITDHILLELAKKEYRYLRNVWAKNSQSEICYFVGGGSAVLKDYIKALNNKLDGYNIEFFEDENESIWMMANAYYKLITDFVQKSSPQVVEKEKKTTKSK

SEQ ID NO: 184 - protein, 359 aa, Proteus vulgaris; identical to SEQ ID NO: 24

SEQ ID NO: 185 - protein, 364 aa, Pseudomonas resinovorans; identical to SEQ ID NO: 25

SEQ ID NO: 186 - protein, 324 aa, Vibrio cholerae; identical to SEQ ID NO: 29

SEQ ID NO: 187 - protein, 351 aa, Symbiobacterium thermophilum; identical to SEQ ID NO: 55

SEQ ID NO: 188 - protein, 333 aa, Azoarcus sp.
MQRTIIGLDIGHSSVKVVASSSSGRHQFLFPSVAIPAFAISDEGEARIAATETVAVGQRKFFVGETALVQSCGQPPALGLTNDWIETPEHSALIAGAAKKLERLGLDLRNCLVVTGLPSALHTHQKARMREVVRQQIQAEVLVAPQPFGPLQTLMLTPAGTLSSAHDMCEENWAVVEIGHFTTDFLLIQSGRIVEKASGSCGGVRLAVEHMQRLLNQENIQVDHFEAEQALRERRIKYFGKALDVTEYAKQAISLIASEVMDTASRVLDPVARKLDGILIAGGGAPVIFPELSLKWPHATIANEPRMAIAEGFCRFGMSISAKTQGAKEPAAA

SEQ ID NO: 189 - protein, 305 aa, Clostridium perfringens; identical to SEQ ID NO: 93

SEQ ID NO: 190 - protein, 369 aa, Desulfitobacterium hafniense
MFENDILVAGGDPGFGAIKLDAGDTKVLFPAVICKGNERIFSALGNGNVSRGTDEEMQTGSLDVIVTNHSTGVSRHYFMGSLAESLNPNEAHYCWDEDKSTDEEATALLVVALAVAQKEPKANIYLGTGVPVKYYAALKDKYEAELKGTWSVAFRSGPFKGQTRQLTIIRSRVLPQSYGVFIKETLNEYGIPISPKLFNGYVVVIDPGFRTTDVATFYDGVMLDPPNSFSIEKGLKWAYTGVAEQLKEMTINHANPIETDDKELDKVFRVNEGMYPWNNGAINLNPVMQDMLGQLGTDISREVKKSLKPMLGKIHTVLVAGKVGEMIFEHLQFENKVLIENPQFGNATGFRIMAANLVNNITKKANAAP

SEQ ID NO: 191 - protein, 290 aa, Clostridium acetobutylicum
MITVVDLGNFNIKYKSGSNQGNFSSKITDYQPYPEGFERIQMQGESKITYLGVGELNKEFNKVARNYLPQLLYAICRANNYDNIETNLVTLLPIVQMKNKEKMIENLKEKEFNFQFNGEKRKVLINDTIVLPEGYATYFSLSEEDKESSLCIIDLGSRTINICVLQDGAIQLLHTIKLGSFDFYTKVKTRENSKGEDYTEEDIPRLVENGTIEISDIEYEDFLTEVLNEVKAYVNLKTYKVIWTGGTALMLKEQIEKLPLNNSKLHNDPLNSNTNGAAGAAEIIWQSEEE

SEQ ID NO: 192 - protein, 409 aa, Clostridium acetobutylicum; identical to SEQ ID NO: 5

SEQ ID NO: 193 - protein, 334 aa, Thermoanaerobacter tengcongensis; identical to SEQ ID NO: 61

SEQ ID NO: 194 - protein, 341 aa, Bacillus cereus; identical to SEQ ID NO: 43

SEQ ID NO: 195 - protein, 341 aa, Bacillus anthracis; identical to SEQ ID NO: 41

SEQ ID NO: 196 - protein, 341 aa, Bacillus cereus; identical to SEQ ID NO: 37

SEQ ID NO: 197 - protein, 348 aa, Moorella thermoacetica; identical to SEQ ID NO: 125

SEQ ID NO: 198 - protein, 341 aa, Bacillus cereus; identical to SEQ ID NO: 38

SEQ ID NO: 199 - protein, 383 aa, Anabaena variabilis; identical to SEQ ID NO: 68

SEQ ID NO: 200 - protein, 349 aa, Lactobacillus paracasei; identical to SEQ ID NO: 103

SEQ ID NO: 201 - protein, 347 aa, Dechloromonas aromatica; identical to SEQ ID NO: 80

SEQ ID NO: 202 - protein, 354 aa, Dechloromonas aromatica; identical to SEQ ID NO: 89

SEQ ID NO: 203 - protein, 363 aa, Nitrosococcus oceani; identical to SEQ ID NO: 113

SEQ ID NO: 204 - protein, 341 aa, Salinibacter ruber
MFKTKTLPSVFEASNAELVDVSDSLLTGLKIGHNGRSYVVGELALLEGNAPHKGINNAPSDLDYRLLLQAALAVTKAGAEEPMYVTTGFPSSTYAAHRDTAEELVKGTHVIDLDGRTFGKSPDTSIRVEVDQVEIIPEIEGFTFGVRQGEPRERDPFFAVGLGYGTMEAALSLPSGIVQRTTASASGLQYATQLMSDRLQKEHYLDMVTEHQLDMAMRKGSIVIGRKKMDLTEMRQDVLSTYYEDIVSPTLKRAFDDADFGRARKMYVGGGGALFDELVDAFTDEFGDVLSLEVVPNPASFISQGYALHAADANGGHRARAVGLDIGNANTVINLLREESV

SEQ ID NO: 205 - protein, 322 aa, Syntrophus aciditrophicus; identical to SEQ ID NO: 120

SEQ ID NO: 206 - protein, 423 aa, Bacillus thuringiensis; identical to SEQ ID NO: 71

SEQ ID NO: 207 - protein, 341 aa, Bacillus thuringiensis; identical to SEQ ID NO: 39

SEQ ID NO: 208 - protein, 369 aa, Rhodoferax ferrireducens; identical to SEQ ID NO: 78

SEQ ID NO: 209 - protein, 409 aa, Lactobacillus salivarius; identical to SEQ ID NO: 147

SEQ ID NO: 210 - protein, 355 aa, Polaromonas sp.; identical to SEQ ID NO: 91

SEQ ID NO: 211 - protein, 394 aa, Polaromonas sp.; identical to SEQ ID NO: 76

SEQ ID NO: 212 - protein, 324 aa, Vibrio cholerae; identical to SEQ ID NO: 30

SEQ ID NO: 213 - protein, 332 aa, Ralstonia eutropha; identical to SEQ ID NO: 83

SEQ ID NO: 214 - protein, 308 aa, Clostridium perfringens; identical to SEQ ID NO: 109

SEQ ID NO: 215 - protein, 369 aa, Desulfitobacterium hafniense; identical to SEQ ID NO: 105

SEQ ID NO: 216 - protein, 343 aa, Acidovorax sp.; identical to SEQ ID NO: 75

SEQ ID NO: 217 - protein, 281 aa, Clostridium phage phiSM101
MILAVDLGNYNIKTSENILFESRYEEVEKEDFDTDLLEFDNKSFRMESGDFENEFNKAKKQYIPNLLYAIAKSCDKNKVEIDLVLGVPASNLGISENFKTELSDREFKFTLFGTKKVVKINKVATVAEGLSSFYTLPKEERLKDIVLLDIGGRTINVCTFTGGKCSLKFTVPGGMLDLYSQIQEDYNKVGNNADVEEIIRLIKNDTIDASNAKERFVKSQLNKIRLQVPNFSTYKVYLVGGGSLELQEALRNQLENINFVPDTVFSNAKGNKLIAKAKWGE

SEQ ID NO: 218 - protein, 349 aa, Verminephrobacter eiseniae
MPDVIAIDVGYGNTKPVWSHDPDKSGKERWGEACFPSITPMAMVDEESTGGAYNPDRILITVRNKGYYAGPAASMGIEARTLDPDYIESDDHEVLLRAAIHWAMREKRALLPAIDMLVVGLPVSGFSARGKRLRDIALAPRDVPVPRVLQTSGVPAVITVRAKQVKVLPQPFGSLRYAAQNLPDTDELFSDRALSMVIDPGYRTFDWFVANGMRPEMKLSGSFDGGVSNILRQVSQKIGYEHGTGSLEFDQVEEGLLRGAINLGYKVIDTRPYQAVVLDAARKEVMAFLGRIDANKARLRRVFLTGGGASYYKLALAEKLPGYQIQMLDNGLMGNARGFWLSGYDDFDV

SEQ ID NO: 219 - protein, 348 aa, Clostridium novyi; identical to SEQ ID NO: 122

SEQ ID NO: 220 - protein, 341 aa, Bacillus thuringiensis
MKSLYAIDVGIGFTKRAYRQDEDSEVTVKSEASTLAPVPNHDESEDLTKVSFIDLDFAYYMGNEAHQSDASFLPPFEEEIENYYESEQFKQQIFGCIAKDYKENVVLPLVVTGLPVTYFGSQHEQLQRALKKETSVQIDGKFIHITVENALILQQPVALHAYFLKEGIIQERDRILIIDGGFRTLEMTDMKQNVILNHYETELGCSKPLKNIKNILQNHAGESNQLHINDMPNILEKGYGGREENPQASQVHTLIQKELDTHFQDVMCVLQEQFKLDQYDTIIWTGGIVDLHKKRIEKMQGEISSFRMVDASKEAALHGYYMIGSQVFDDITNQSVYESKL

SEQ ID NO: 221 - protein, 389 aa, Bacillus thuringiensis
MSILLKAGADAGNNGLKLMVKGQDPIFIPSIYALYIGEPTGLLDEEDVSLSELENHIDVTISSPSLMLNNVRYIVGEKVIQDQLKGTEVEKKSNKSTDELMVITILSGLAVSAMRQSPTSSHINIRYDLSVALPMQLITQEIAAENAKRYMGNHKVVFHYPNGRDVTINISIEYCKCLPEGASGTWGIVYDEEGNVVKHKIECEQNKVSEIDFVDKTLLSFDIGAGTTEEVVSLGVNFRPQLSKGLSYGVKETLLQIITRWNRKYPTKTIDSITEFNQIYLNDKHPRNALLVEESQPALLGLAARVATDIINKIDDMKDDPYVFIYGGGAVIIKNSLKMILKQKGRLTNVIFVDNPLFTNARGLLVYTCSPKYREHKQKELGFTNLTIS

SEQ ID NO: 222 - protein, 334 aa, Burkholderia ambifaria; identical to SEQ ID NO: 87

SEQ ID NO: 223 - protein, 334 aa, Burkholderia multivorans; identical to SEQ ID NO: 87

SEQ ID NO: 224 - protein, 371 aa, Lyngbya sp.; identical to SEQ ID NO: 66

SEQ ID NO: 225 - protein, 381 aa, Nodularia spumigena; identical to SEQ ID NO: 69

SEQ ID NO: 226 - protein, 332 aa, Ralstonia pickettii; identical to SEQ ID NO: 84

SEQ ID NO: 227 - protein, 324 aa, Vibrio cholerae; identical to SEQ ID NO: 32

SEQ ID NO: 228 - protein, 418 aa, Lactococcus lactis; identical to SEQ ID NO: 104

SEQ ID NO: 229 - protein, 350 aa, Leptospirillum rubarum; identical to SEQ ID NO: 117

SEQ ID NO: 230 - protein, 328 aa, Acinetobacter baumannii; identical to SEQ ID NO: 101

SEQ ID NO: 231 - protein, 384 aa, Cyanothece sp.
MSDLTMALDFGSSLGRAIYTTSSSYVKPELLLLDPHVVEVPNISIANYEKYKVGNPSPQDSSWVNLNDTYFAVGFLAKRQFSTIHCLNSLKIDSAIPLTLAMVGAVAEIKGLGTTFSLDLGVLLPWSEFKDKDKLKSVLDSALQSFEYRGQQYHVTLQAFDALPEGGGLFARGRVASKGKPMKRVTETNLVVLMIGYRNASILVVERGELTIGLTSEFGFSQMITKIKTFTSGQSEDVLIPAICTGKSISDRTLERLARSQRAELREAEKKEIKDAIEDSQQEYVATLTNWISQQIPPHLEIDEILLGGGTAKYFKRNLTTLLKSYGAQINWSQSLEKRVVQTFGNEVSKNYLASRLADVYGLFYRLLKKPLPRLKEVVTRESA

SEQ ID NO: 232 - protein, 346 aa, Marinobacter sp.; identical to SEQ ID NO: 116

SEQ ID NO: 233 - protein, 327 aa, Yersinia ruckeri; identical to SEQ ID NO: 26

SEQ ID NO: 234 - protein, 383 aa, Geobacillus thermodenitrificans; identical to SEQ ID NO: 137

SEQ ID NO: 235 - protein, 315 aa, Aeromonas salmonicida; identical to SEQ ID NO: 33

SEQ ID NO: 236 - protein, 303 aa, Clostridium kluyveri; identical to SEQ ID NO: 96

SEQ ID NO: 237 - protein, 401 aa, Bacillus sp.
MRRDYMERSNFLAVDIGNSWYKVLASTDGVVSEYQMPNAIALFDDEFYEMPYEEEDVEIEENLIVEVKSPSVMNKREIFYAGKSAARQRNVSLTSVNNQKVDEVRTYILLFSAAAYHALLTSENEMDIVYEIDQLAVSLPTTQYKEKKEQLKQRLIGSHTVILHKVPGVPEPKEVCVKIKINDVIVGAEGACAYLGLTRDQETLGIKDDGLVKDSAKGILIGDLGGDSVDFVGIKNSKPVASVEGEHFGINQFLDIIIQKVSKNELYKFDSRSELEEKLYAGQSEWYVEPFAGVRKDISKYVIPQLKSMAIKYLELFDRVRSSSNEIKGASRYIAVGGAAKLAQKQIQEAAVRWSEKGRPINLYFPEDLEKLNVLGLMILAKMNHLKKQQEETTDLAATRG

SEQ ID NO: 238 - protein, 332 aa, Ralstonia pickettii; identical to SEQ ID NO: 85

SEQ ID NO: 239 - protein, 350 aa, Ralstonia pickettii; identical to SEQ ID NO: 77

SEQ ID NO: 240 - protein, 298 aa, Bacillus cereus; identical to SEQ ID NO: 52

SEQ ID NO: 241 - protein, 326 aa, Beggiatoa sp.
MFNLKSQRKVQLAIDIGNRLLKSCTSNGAIKTLPSWYKDLEEWDMPHSDKNSVVIHYLQGVNTNLVKKSWAVGNVAQDLGGNPTFESEKAFLAPKLALAMIDAGGGTQQITVERLVCALPNELQEEKVDAIVKGLTGTHQIKRNGEELKIEIEKVEVQPETLGAFKWVLANKSFKYARINGILDLGGKTGIGQLYTKNGTLIRESRIIVGGTYQLAQFVAQHPKLIRLDTTPQLSLIMDAIADGSLSYGTMDINFADKFPIYVSQWLDDIRNKLKLSWSKWLSELGEVVIVGGSAVLAKPIVDQTAGRFKIVKENSQFCSVLGMLQ

SEQ ID NO: 242 - protein, 316 aa, Yersinia pseudotuberculosis; identical to SEQ ID NO: 100

SEQ ID NO: 243 - protein, 330 aa, Bacillus phage 0305phi8-36; identical to SEQ ID NO: 23

SEQ ID NO: 244 - protein, 348 aa, Desulfatibacillum alkenivorans; identical to SEQ ID NO: 57

SEQ ID NO: 245 - protein, 407 aa, Bacillus thuringiensis; identical to SEQ ID NO: 4

SEQ ID NO: 246 - protein, 341 aa, Bacillus cereus; identical to SEQ ID NO: 35

SEQ ID NO: 247 - protein, 341 aa, Bacillus cereus; identical to SEQ ID NO: 47

SEQ ID NO: 248 - protein, 369 aa, Heliobacterium modesticaldum; identical to SEQ ID NO: 127

SEQ ID NO: 249 - protein, 341 aa, Bacillus cereus; identical to SEQ ID NO: 42

SEQ ID NO: 250 - protein, 341 aa, Bacillus cereus; identical to SEQ ID NO: 46

SEQ ID NO: 251 - protein, 341 aa, Bacillus cereus; identical to SEQ ID NO: 45

SEQ ID NO: 252 - protein, 341 aa, Bacillus cereus; identical to SEQ ID NO: 48

SEQ ID NO: 253 - protein, 393 aa, Bacillus cereus
MKTQLVSRKTKKNQPVLVGLDVGFGATKYISNVHPYLTALPSAVVPGKYKTSNKIVGSKEVDLENLVVVTEEGTFTVGQLALKVPNTTTKRTVVRDRANDVFSKVLFQTGLGMAVPHESGEYDVFLVTGLPNKDFELSIKDNLEEFLNKPFTITFPVNGGNEIKKTINVIGLEIMRQPEGAVTYNQFTFSQEEFLVPSENAKNFIGIIDCGHFTTDYALFRDGVIMEDSITSNSTVAVNDVYKRLRKVLTIKFDKLGYTEYQAEEEDLDNAVLTGKVEYVEAHDVSEEVGDCVKTVAKIIAKDILDAWGNETNRVQTILLSGGGSALFSEALKQEFTERKKRGFEVLDVAQFSNVLGYYMYGCIALTDEKEQSEVFMEFVEPVFGEEEVAETE

SEQ ID NO: 254 - protein, 341 aa, Bacillus cereus; identical to SEQ ID NO: 40

SEQ ID NO: 255 - protein, 389 aa, Bacillus cereus; identical to SEQ ID NO: 145

SEQ ID NO: 256 - protein, 389 aa, Bacillus cereus
MSILLKAGADAGNNGLKLMVKGQDPIFIPSIYALYIGEPTGLLDEGDVSLSELENHIDVTISSPSLMLNNVRYIVGEKVIQDQLKGTEVEKKSNKSTDELMVITILSGLAVSAMRQSPTSSHINIRYDLSVALPMQLITQEIAAENAKRYMGNHKVVFHYPNGRDVTINISIEYCKCLPEGASGTWGIVYDEEGNVVKHKIECEQNKVSEIDFVDKTLLSFDIGAGTTEEVVSLGVNFRPQRSKGLSYGVKETLLQIITRWNRKYPTKTIDSITEFNQIYLNDKHPRNALLVEESQPALLGLAARVATDIINKIDDMKDDPYVFIYGGGAVIIKNSLKMILKQKGRLTNVIFVDNPLFTNARGLLVYTCSPKYREHKQKELGFTNLTIS

SEQ ID NO: 257 - protein, 343 aa, Bacillus cereus; identical to SEQ ID NO: 51

SEQ ID NO: 258 - protein, 289 aa, Clostridium botulinum
MKITVVDLGNINVKYVGENKGRFSSKITNDYQSYEEGFQRVEYNGIKTYIGVGELSREFNKADRDYMAQLLYSLAKANTADTKEINLTLLLPIIQMKNKTRLIETLKGENFKFKFNGIDREIKINDLMVLPEGYASYYSLDIENKKGDVCILDLGSRTINICVLENAKIVKTNTIKLGSFDFYSKIKSLENAKGEDYIEEDIQRLIDNGLIKVDSKQYIEFLSDILNAVKPYVNLKTYNTIFTGGTSLMLKEYIEKLPLNKFKVHPNALTSNVDGAMEASKKVWNNGNK

SEQ ID NO: 259 - protein, 355 aa, Clostridium botulinum
MKNIIAGVDTGFGYGIGMTNDTEVIMKNYINNITEKEALNIANTIKELNNKNTLIKYNGKYFICGDACIERYPDTMQRLNRDRIKDEYHLIELLSIVGQLTKESEFNLYLCVGLPNRSKGDSKKFEDWLKGSAFEFSYLCNFGEVKKKVYIKDVTCLPQAYSPIFTLPRNDMNKTIFSVDIGHSTLDLMLVKNMQTVMASDTLLDGEGCIRIYNNLKQALIRQNEDKKITYYSYSQLQEILENGNYSLYGEEQQIENILNRCLEEYAEYVFFTIENNMYKYMPTVDTFIFSGGLLNNNTFKTILSDKFKQAYKIPLLVQNNRSQYTIAEGLKEYSNIKYADKLEVVKENDIKAAK

SEQ ID NO: 260 - protein, 348 aa, Clostridium botulinum; identical to SEQ ID NO: 123

SEQ ID NO: 261 - protein, 293 aa, Clostridium butyricum; identical to SEQ ID NO: 102

SEQ ID NO: 262 - protein, 308 aa, Clostridium perfringens; identical to SEQ ID NO: 108

SEQ ID NO: 263 - protein, 302 aa, Clostridium perfringens; identical to SEQ ID NO: 97

SEQ ID NO: 264 - protein, 308 aa, Clostridium perfringens; identical to SEQ ID NO: 107

SEQ ID NO: 265 - protein, 305 aa, Clostridium perfringens; identical to SEQ ID NO: 94

SEQ ID NO: 266 - protein, 381 aa, Clostridium perfringens; identical to SEQ ID NO: 135

SEQ ID NO: 267 - protein, 303 aa, Clostridium perfringens; identical to SEQ ID NO: 130

SEQ ID NO: 268 - protein, 302 aa, Clostridium perfringens
MKILGLDNGYNYTKTSMGQCILSTVEKGHDDYNNVLEMHLNGKNYIIGEPTGQYIVDANKFKTEEGKELVKLTTLAAIGLSYPEESVIDVSIVAGLPVAFYADQKEELTKLIKGLDDSCIELNKIGKKQIIKINKVMILPQACGIIIEKNKKKESSLVIDIGGGTWDIAQFDGLKLVEKATYEKGMLVLYSAIAQELNSKYYTKFETSDIQNIIDRKFFTVEGNKKGIEDIEEYINNYVRKIAATIKRDFDTTNIDNFYLIGGGAIALESYVKKYFPSIEVEKDCQFTNVNSFAFMGELKLK

SEQ ID NO: 269 - protein, 292 aa, Clostridium perfringens
MKIAIDLGNRNTKLACKTGDKIKRDIFQARFTNEEQQDYTAAEVVEIDGIKYCIEQGNYDFEFNKTEKNYLPLLLAAISRATSDNEVEIMMGAPAEHVSGLRDKFKEQLLDKEFIFKYKDEDRKIKINKLGVIGEGFATYFSIPEEIRNSNTNLGIIDIGGRTINVVTFINGKQHIVCTLNFGILDLKNNLLKELKKAGKDYDLNVVENLLLNNRIKIEEKEKEQLINRLINELKIYKIDIDLYTWVISGGGAEDLGNEILEKYFGENSLMKDPLFTNVLGAYNFMLAKWGV

SEQ ID NO: 270 - protein, 305 aa, Clostridium perfringens; identical to SEQ ID NO: 95

SEQ ID NO: 271 - protein, 301 aa, Clostridium perfringens
MKVSTLGIDLGNANVKTSKSVIFESKIKPGITKMNENDIKVIYNGAEYTVGAYDGALNISKRKYFKTAYKINLLTAIAKSSKANNITTNIVVGVPVESFNDKNLTEEIKKHIESFENEKITVNGVEKTINIENVEVFCESAIVFADREKFKDKKTLVIDFGGGTIDISFWDGLNLTKARTYREGMITLYENVIKQVNNRYSTTLNSNIAIDMIGEDKFTIDQEEKNISFINAIVETYVDGLTSYINQYFDVESADSIQLIGCGAIQLEKNIKDEYEKAELHPNAAFANANTYEKVGEILWI

SEQ ID NO: 272 - protein, 302 aa, Clostridium perfringens
MKILGLDNGYNYTKTNMGQCILSTVERGHDDYNNVLEMNFNGENYIIGEPTGQYIVDANKFKTEEGKELVKLTTLAAIGLSYPEESVIDVSIVAGLPVAFYADQKEELTKLIKGLDDSCIELNKIGKKQIIKINKVMVLPQACGIIIEKNKKKESSLVIDIGGGTWDIAQFDGLKLVEKATYEKGMLVLYSAIAQELNSKYYTKFEASDIQNIIDRKFFTVEGNKKGIEDIEEYINSYVRKIAATIKRDFDTTNIDNFYLIGGGAIALESYVKKYFPSIEVEKNCQFTNVNSFAFMGELKLK

SEQ ID NO: 273 - protein, 376 aa, Natranaerobius thermophilus; identical to SEQ ID NO: 54

SEQ ID NO: 274 - protein, 355 aa, Clostridium botulinum
MKNIIAGVDTGFGYGIGMTNDTEVKMKNYINNITEKEALNIADTIKELNDENTLIKYNGKYFICGDACIERYPDTMQRLNRDRIKDEYHLIELLSIVGQLTKESEFNLYLCVGLPNRSKGDSKKFEDWLKGSAFEFSYLCNFGEVKKKVYIKDVTCLPQAYSPIFTLPRNDMNKTIFSVDIGHSTLDLMLVKNMQTVMASDTLLDGEGCIRIYNNLKQALIRQNEDKKITYYSYSQLQEILENGNYSLYGEEQQIENILNRCLEEYAEYVFFTIENNMYKYMPTVDTFIFSGGLLNNNTFKTILSDKFKQAYKIPLLVQNNRSQYTIAEGLKEYSNIKYADKLEVVKENDIKVAK

SEQ ID NO: 275 - protein, 383 aa, Geobacillus stearothermophilus; identical to SEQ ID NO: 134

SEQ ID NO: 276 - protein, 355 aa, Clostridium botulinum
MKNIIAGVDTGFGYGIGMTNDTEVKMKNYINNITEKEALNIADTIKELNDENTLIKYNGKYFICGDACIERYPDTMQRLNRDRIKDEYHLIELLSIVGQLTKESEFNLYLCVGLPNRSKGDSKKFEDWLKGSSFEFSYLCNFGEVKKKVYIKDVTCLPQAYSPIFTLPRNDMNKTIFSVDIGHSTLDLMLVKNMQTVMASDTLLDGEGCIRIYNNLKQALIRQNEDKKITYYSYSQLQEILENGNYSLYGEEQQIENILNRCLEEYAEYVFFTIENNMYKYMPTVDTFIFSGGLLNNTTFKTILSDKFKQAYKIPLLVQNNRSQYTIAEGLKEYSNIKYADKLEVVKENDIKAAK

SEQ ID NO: 277 - protein, 333 aa, Clostridium botulinum; identical to SEQ ID NO: 82

SEQ ID NO: 278 - protein, 333 aa, Cupriavidus taiwanensis; identical to SEQ ID NO: 82

SEQ ID NO: 279 - protein, 334 aa, Burkholderia ambifaria
MKTAVFAIDVGYGNTKYAHRAANNAVASGMFPSLAPLAASRSIAGYGDSVLTARKVATIVIDQVEYEVGPDVSLTAAYGNTGRALADDYIRTNNYAALLLGAIHFSGVTHIERLVLGLPVHNLKKYAGALMERFTGTLDFGAGRVKIDKVMVIPQPLGSLVLASSNRKGGFGRDVEHLVVDVGYFTTDWVYASGFAMDDKRSGGMPGGASQIYQRIAQLIARDQGDAVEDIERIDKALREQTPFFFYGNDIDLAPYLEKAQPLISGVVKEMQNNVGRLANVRSIILSGGGAALYASVIRQAFPRVVIEVIDAPCLANVRGFLLVGESSVARERR

SEQ ID NO: 280 - protein, 399 aa, Cyanothece sp.
MVCIVKKRELKEKEKMADLTMALDFGSSLGRAIYTTSNSYIKPELLLLDPHVVEVPNIAIANYEKYKVGNPSPQDSSWVNLNDTYFAVGFLAKRQFSTIHCLNSLKIDSAIPLTLAMVGAVAEIKGLGTTFSLDLGVLLPWSEFKDKDKLKSVLVSALQSFEYRGQHYHVTLQAFDALPEGGGLFARGRVASKGKPMKRVTETNLVVLMIGYRNASILVVERGELTIGLTSDFGFSQMITKIKTFTSGQSEDVLIPAICTGKSISDRTLERLARSQRAELREAEKKEIKDAIEDSQQEYVATLTNWISQQIPPHLEIDEILLGGGTAKYFKRNLTTLLKSYGAQINWSQSLEKRVVQTFGNEVSKNYLASRLADVYGLFYRLLKKPLPRLKEVVTRESA

SEQ ID NO: 281 - protein, 379 aa, Clostridium perfringens; identical to SEQ ID NO: 138

SEQ ID NO: 282 - protein, 297 aa, Clostridium botulinum
MNIGIDLGNGYTKFKGKKFASKVKMGRLANFGEKNKEVHEVKYNNASYVVGEGQFFITDDRYFTNEYKICLLTAIALASNEIVIEANICVGLPVMKYMSDVKRRLEDHLNTIGAEKITVNGEEKIIHIKSVTVFVESALVVKDRSQGNEITIDIGAGTENIIQWENGVPVNFDTKNKSFYNLYNKISKYLKDVGKGDVSTEYIEKTLGQDEIIINQELVDIRDTHNIIEQHVRELASKIISEFDISRARRIRLMGGGGLPTYKYWKNIIEKVELADNAQFINSEIYETVLEMSGIND

SEQ ID NO: 283 - protein, 305 aa, Burkholderia multivorans
MFPSLAPLAASRSIAGYGESVLTARKVATIVIDQVEYEVGPDVSLTAAYGNTGRALADDYVLSANYAGLLFGAIHFAGVDHIERLVLGLPVHNMKKYSAELKERFTGELNFGAGRVTIDKVMVIPQPLGSLVLASSNRQGGFGRDVEHLVVDVGYFTTDWVYANGFTMDDKRSGGMPGGASQIYQRIAALIARDQGDEVEDIERIDKALREQTPFFFYGSNIDLAPYLEMAQPLISGVVKEMQNNVGRLANVRSIILSGGGAALYAGVIRRAFPRVVIEVIDAPCLANVRGFLLVGESSLARERR

SEQ ID NO: 284 - protein, 352 aa, Acinetobacter baumannii
MKGYKTLTVGVDDGHDGIKIYCGEVGKSFRLPSRVANGRTIIGDTDEVNKQIIHVNGKYFTVDEFTKEHIDTRTEDYPLSDANVALVHHALHQAFDGQYRKFKIATGLPLNRYYGGKDKAKNEKLIADKTQNLLINKDFNNPTVYNLYEHDKKNDPLQILNHIVLSEGQCAYFDALMDDNGKRSSMYEDLWEGGCAIIDIGGRTTDIAMINPRGGTMQASRCDTLDVGIITLKNKVSQNLKEFFGLSSNITDWRLSKALKTGIYNHGGKDHDISKILNAAKVEITDQIENSIKVNVQDGQDLGAVLLVGGGSITLGDELLKRFNYDNWHLVKQPEFANARGMYKCAKYISKL

SEQ ID NO: 285 - protein, 324 aa, Proteus mirabilis
MFVLGVDIGYSNLKLAIGQSGNEPKTIILPAGAGPADRMPERIGGGDDETCLYVSVDNERWAAGVPAGRLQGWERELHPEYPTTKTYKALFHAALLMAETESIDLVVTGLPVSQFHEPQRKSDLVQRLKGVHQVTPKRSITVHDVKVLPQPAGAYMDLVQTGGDLGLIEEGRVVVIDPGFFSVDWVALEAGEIRYSSSGTSLQAMSVLLETIDKLISEDHGAKVGMDRLEKAMRTGDLQVLLFGEKVDISPYLNAAMKKVAPVALTAMRQSMRDESINADLVLIAGGGALAYKEAAKEIFSRSKIIVPEQSVLANVRGFWFYGA

SEQ ID NO: 286 - protein, 383 aa, Geobacillus sp.
MKLVVANDIGNSETKMIVNDTLIKQPSVVKRLLSKPNVTETNVEKNIANLLDELIVHVTSNAIKRSGLYFIGKRANMTADKVENMNIKLGNKSKHDIPVLMTLSMLAARSVQLAYQENQELPPSISVDVSMTTAIPASEYSADQARYLEGRFTSNDHVVIVYVGETPVTVTLHFQTVKVTQEGIPALYALLESENEILKNYNEHYKKQAVPKDFANKRILHVDIGDGTTEYVYTVGINPVTDVCSGEKRGVGHATEEATQLLKEEVGGFLNLNRQQFMDIFRDPSHHLHDLAVRFMQEARYSQAQRILEDIQEKYSDIAGNVDVIAVYGGGSIQFKEELYEELLDFANTVHCEVLWIPEKYAVDMNVNGLHVINEKILFKQHA

SEQ ID NO: 287 - protein, 343 aa, Bacillus phage IEBH
MLLGNPYAIDLGNGFTKRASKKNKSLEADVITELSVLAPVDDYYNEASFTKIELTNTDFPYYIGEEARKSKLPLIRALGENKAKRYEDPTFKKQLFGFIAKDFKKNVTIPLLVTGLPVSHFGNQRESIRKVAMEETAVKVNGELITVKVKECLVIPQPVGTQYYLVKKEIINKEDRILIIDGGFGTFDVTDMSGNAVIDRLGTELGCEKAFMAIEQIVRDNIGETPDLSVSNMHYILENGYKYNGSLYDLYTHKDVAEKVDEELQRHFDAALREVSQKFNLAVYDKIVWTGGMAALHKKRIEKKKEQFPTFAVLENGQEANLLGYYYLGCDVFDKLTKEKAAN

SEQ ID NO: 288 - protein, 407 aa, Bacillus cereus; identical to SEQ ID NO: 133

SEQ ID NO: 289 - protein, 374 aa, Arthrospira maxima
MQSNKQPGQSQSQSPLAKATTTTTKPTTTTVVGRSTILSVDLGRTATKSCISRNPADVVFVPSNVAQMSVEKARGGGFESKNTDPLLDLWLEYQGNGFAVGQLAADFGASLFGVDPAANPSKVNDALIKIFACVGYFNLKGDLDVVLGLPFYSQEQFEREKEQIISLLTGPNTLVFRGEQVVVDIQSVRVMPEGYGSLIWCEAQGSKDAPNFADLSVAVVDVGHQTTDFLTVDRFRFARGVSQSEVFAMSKFYEEVAAKIEGADAQSLFLLEAVHKPQGQRFYRPRGATKPANLDEIVPELRKVFARDLCDRVVKWLPERVTDVVITGGGGEFFWQDLQPLLKDAQLRAHLTQPARKANALGQYVYGEAQLAKR

SEQ ID NO: 290 - protein, 339 aa, Bacillus phage SPO1
MTHISAIDIGFLYTKAIIDGKQVKFKSVVGNGREQNFQNLDFGMNNSEDNITVKTGLDVNFVSDLAINQSDVVLHSLEADRFSNEVTKQLVLTAFGLGFGSDHVETKIVSGLPVSHYSKYQEEIKKLFVGDGSYKIHNFDVTSKGYQIKGSAKVVEAEFIPQPFGALLDRILDKDGDIADKELAKQTVAVIDPGFGTTDVYVSRSLSPIERLTFSTPTAMNFAYDLIANKIEEQTGISLAHYKLEKAVSNKYYRVEGKQYDLTAIIQWAFRSASTQLVTEVLNRWKANSKEIDKVLIAGGTGAAWSKWLKEKFPTAEILEDTQWAVANGYYKWGVRKFG

SEQ ID NO: 291 - protein, 317 aa, Anaerocellum thermophilum
MKCAVDVGFGFTKAVNEKGKEVIFPSAVAKTFLTDIGLKPTSEYFITYMNQTYAVGKAATHCMITETSFSDDRFVSEFSKLLILTALMALDSDREIELGLGLPLMLYPKLKEKVRDYFEFAEEIIVDSNNVAHTYHITRCEVFPQGVGALFSIDSNIEKGIYCVLDIGFRTTDVIVVEVNENNINPLLELCFTLDKGMSMAIEKLSIILERKYGVSYDTNLLLDIHERSQISVRGRKINIEEQKKEVFNTIANDIVQSISRKLQRGFDTFDGVFVAGGGAFNIAAVLQKEFENVQVINNAQFANAKGFLNLLSILDE

SEQ ID NO: 292 - protein, 370 aa, Carboxydibrachium pacificum
MRRKIDAPIRRFFIFAKKFKGGGVQVFKIGLDLGYGYVKGVNEAGKTVLFPSLVGNAYQRNLIGLFWQNLNNLIENMHVVLRNGKEEQEEYFIGDLARREGRNVSYAFDENKINHPNTKAVLASASALLFPSNDEPVHIVSGLPLEQYIHQKDELREMLKNFKAIVEFKGYNILKIVKFDRVTVFPQAAGAVYYAIMDDLQKYLIKGSYIGLIDIGYRTTDYIVFVVDGKLSLREDLSGTLDIGMSQLSNAADKLFTQRTGSKLDIPELIQLVNEGSIFYRGKILNFEKELNEVKLEISRVIQDRIKAVWGSKLDFFNTIFLAGGGAVSLFDSLKNLYENTVLVKNSQFANAKGFLKVAELEEKKERDRE

SEQ ID NO: 293 - protein, 344 aa, Carboxydibrachium pacificum
MFKIGLDLGYGYVKGVNEAGKTVVFPSLIGNAYERNLKILFENGFERKIDNMHLIIMNGQKQEYFVGELARRESRNVSYAFDEDKINHPNTKALIAASCLLLFPEDGRPVHLVTGLPLEQYIHKKEEFKEMLKDYKTIACFKGDERVKGIKFDKITIFPQAAGAVYFAVMEDLHRYLVKGSYLGLVDIGFKTTDFIVFLVEDRLVLREDLSGTIDLGISAVYNAADKLFTQKTGSKLDVPELMRLTADGKIFFKGKQLNFTEELKNIKAETARVIKDRLKAVWGNKLDFFNTVFLAGGGSKDLQEFLNDIYENTVIVKDPQLANARGFLKVAELEEKKTNTKEG

SEQ ID NO: 294 - protein, 347 aa, Alicyclobacillus acidocaldarius
MLTIGLDVGNGSIGLCVRDGDTLVQDTMPSVYGRVDLTRRVLSVPGRSASREVDVFTFGGEHFVLGYQNVHVMHSTPIGAYDREQRYASRQLETLAKLALLDAATRTGRTGVIEVAVACGTPSEDFTTRTVEIMQRWFSEPVTGAKNGEQVVVMIKRLEVIPQPFAVFLDAYLDQDGLVVDEELEKQDVLVIDSGSGTLDLSEIHRLELTRQTSIPAGLNDVYQLILEEIRREEPKVYATAYDLEAQLRAQDGAQEFWFEYGALRMNITELRERAMRQVWDRMQQGIQYAYPDRSSFGRVILAGGSGEAFRNYFLAWMPSIRIAPEPQLAVARGLYKYALAQGAEES

SEQ ID NO: 295 - protein, 313 aa, Acidithiobacillus ferrooxidans
MTCLGMDVGHSSVKLSWRCPDGKVVKLMIPSVVIPAMRITDKTAADTALDDTVDVAGNTYFIGNTALHEVGNLRVSGLHDRWLDMKEFRALVQGAIDKVTRNAGKIERIVTGLPASTFHEQQLKMRNIVSACLDTQIRVLPEPNGIYLQHMIGLEGGVRKDRVVNAGIVAIGRYTTDFMALLDGRWVEGVAGSCSGMSRAANLLLKQLKNEGLDVDYLDADDALWKREIRNYGKTVDVSRDADRALSILGSEIFDSASARFGDVGRKLEKIFVGGGGADLLIGELTEYWPQAELVEDPRFAVAEGFRRLGESL

SEQ ID NO: 296 - protein, 349 aa, Lactobacillus gasseri
MDIFSLDLGNKQTKLKSSKAEYVLPSRYLNQADMPMSVGNSTMNNDLHTYSVPFSDDKYVWGRDIDRLHLDEYLADTIMYGARYDSEAFKLLANFALGLLASDFKAAKDQVLEVVVTAGLPTGDYANQGQLKALLKVLEGQHQATIDDKIVTVRVRKVYILPQPIGTLYNELLDDEGFIQNKDLLDEKVGIVDVGGGTILIDTILNFELSGKNRHQFNTGVNDLYEAIANGINGDTSLYQLEKDLRKGNQQHHWSYRFSKNRQDDITDLVCKEIDRFTRRLVANVTSTLKNLNSIDTLFFTGGGANLLNQKILNTTFTNAVIVENTEVANVNGFYKYGLSQQAQEEGSK

SEQ ID NO: 297 - protein, 341 aa, Bacillus cereus
MKSLYAIDVGIGFTKRAYRQDVDSEVTIKSEASTLAPVPNHDESEDLTKVSFIDLDFAYYMGNEAHQSDASLLPPFDEEIENYYESERFKQQIFGCIAKDYKENVVLPLVVTGLPVTYFGSQHEQLQRALKKETSVQIDGKFITITVENALILQQPVALHAYFLKEGIIQERDRILIIDGGFRTLEMTDMKQNVILNHYETELGCSKPLKNIKNIVQNHAGESNQLHINDMPNILEKGYGGREEDTQTSQVHTLIQKELDAHFQDVMRVLQEQFKLDQYDTIIWTGGIVDLHKKRIEKMQGEISSFRMVDASKEAALHGYYMIGSQVFDDITNQSVYESKL

SEQ ID NO: 298 - protein, 336 aa, Bacillus cereus
MTKVFAIDHGNGAVKMRTDVFKKTLPAIYSFSSNVGEALSGGKMKLKTYKVEGTEYVWGDDIIKVSNTLNTYAQQNRYKTNQYKTLSKIALAEMAAKTNVKSYDEILVITGVPSQEIGTKAVDEIKEVYQGTHEVEVNGKKVIINVVDVIVLAQPVGTVMSRYLDEDGFVADDSYEDMTVGIIDIGTGTTDLDVISMLRREKESTSVPKGMHDVYEPIVAKIKKETSATINDYKLEKVFEEGAYQASKRMDPIDFNDEKTASIKEVYDFIVNGVNNAWKTFDRFDEVLVSGGGANTFHELLEEWIGKVTKLEESQTANVEGFYRYGKFEVGEEDGE

SEQ ID NO: 299 - protein, 380 aa, Desulfobacterium autotrophicum
MEVVGIDVGFGFTKAFNGKNSVVFKSVLGDSTQIQFRSSLGDDQDNSNLHVTLDGKSYFIGSYAEQQSNVKEFTLDQDKLLTDFVKVLALTAIGVCCENNASLNVVSGLPVGFLTRDYKRFADLLTGRHEIIFHYENKDDITRRIHINKIQMIPQPIGSIFNLLMDDRGKITDRKLSGQKIGVVDIGFKTTDFSIFDHLQYIERSSTTMDTGISKCFSLIANKLRQESGVNIELYRMFSFIESGAIKIRGREYNIANLKKRVYAHAAAAIAADVNRLWEEDWDMDSIILSGGGSMELAPFLRSLIQGNVIPIANDVDTRLNNVQGYLKFGRHKWGYTETPVSDLPDNKETTTETNKDTALESDQNSGETKGRGWLKGSRT

SEQ ID NO: 300 - protein, 306 aa, Helicobacter pullorum
MDAQRIAIDIGYGDTKVMANGKLFKFPSAISQVGESMLQLDFKSDNPIFEGIEYRVGSKALMEAVATRGYLFLKRYSPLLIHNALLEAKFDLEAPIEIATGLSIVNNLEAQNFLEIISNFTINQIQIKPRVFLFAQGQGLYYQSGLDKEDRACVIDIGYNTLDFLVFENGKPRVDLCFANKKGANLAITNLQKFLIKEFRVDFNEQEAKEVFVKKEIEIAGKKIDFSDVINSIMQRYVRTITDEVFSKAEDILSKTKNIVIGGGGAYFLKKEYLEDLHKANYLFLDNPEYSNVLGYYKSAFKTKGV

SEQ ID NO: 301 - protein, 349 aa, Lactobacillus paracasei
MDIFSLDLGNKQTKLKSSKAEYVLPSRYLNQADMPMSVGNSTMNNDLHTYSVPFSDDKYVWGRDIDGLHLDEYLADTIMYGARYDSEAFKLLANFALGLLASDFKAAKDQVLEVVVTAGLPTGDYADQGQLKALLKVLEGQHQVTIDDKIVTVRVRKVYILPQPIGTLYNELLDDEGFIQNKDLLDEKVGIVDVGGGTILIDTILNFELSGKNRHQFNTGVNDLYEAIANGINGDTSLYQLEKDLRKGNQQHHWSYRFSKNRQDDITDLVCKEIDRFTRRLVANVTSTLKNLDSIDTLFFTGGGANLLNQKILNTTFTNAVIVKNTEVANVNGFYKYGLSQQAQNEGSK

SEQ ID NO: 302 - protein, 379 aa, Nostoc azollae
MTDQPPVANPMNAAAIPMNRVAPTPINNNVNKPVSVSGKNILSVDLGRTSTKTCVNREPANVAFIPANVKQMSIEQIRGGVFESKATDPLMDLWMEYQGNGYAVGQLAADFGANLGVGQSKVEDALAKVLVAAGYFKLKDEISVIVGLPFLSLEQFEREKAQLMSLISGPHVMNFRGETVSLNVTKVWVMPEGYGSLLWCETQPNKGSSMPDLTKVSVGIVDIGHQTIDLLMVDNFRFARGASKSEDFGMSKFYEMVAKEIEGADSQSLALISAVNKPKGDRFYRPKGASKPANLDDFLPNLTEQFSREICSIVLAWLPERVTDVIITGGGGEFFWEDVQRLLKEAKIHAHLAAPSRQANALGQYIYGEAQLSAVRAAR

SEQ ID NO: 303 - protein, 313 aa, Dethiobacter alkaliphilus
MKESVVGIDLGFGWTKAGHNGQFFRCPSVVGEAVNLFESPTGIENNIQLWYNDQHYFVGELAIRQATIKYFSMAANKARSDISAILAATALAALKPGRVNIVTGLPVDFYFQYKDDLDNQLQHLPNRVRIQMDNKTYNCALEVQQTKIVPQPLGSAMSLILDSRGNTIDHRLASKNILVVDVGFHTLDILALSALEIIRPFSFTRPLGMAVAYKGISQDLGGLPLYDVDRLFIKNQLQNHTAAFQSLARQITEEIAGLNQKFDHYLITGGGGAQLYNWLLPGFERILVPDAQQANVVGYQKLGAKTWSKRNIS

SEQ ID NO: 304 - protein, 280 aa, Persephonella marina
MKVAFDLGFGWTKVCTDTGECFKFPTWLAYHSDTAISEVDKVLVDGKEYVVGEDARLERQRITITSIQELLNYFPVFKRYSLEKLGISESEAQIITGLPPIHKDKAEILEKQGAVVLPQGLGIFLDVADKVSEEELMIIDIGFNTVDYIVVIKNKRKKGNTIEKQGVERMIELFRNKLPDSLGYLKQFSFQRLMDVFEKGYATVEGERIDLTSYKERAIEEYNEVLKTRLKDEIGNLIDEIERIVIAGGGAYYLKDIRKAGIYIPEKPEFSQARGYLKYE

SEQ ID NO: 305 - protein, 301 aa, Clostridium difficile; identical to SEQ ID NO: 129

SEQ ID NO: 306 - protein, 314 aa, Clostridium difficile
MKKEKVKVAVDLGNSMLNSAAYIEKELILKKLPNKLQFEKTISPKARVMKKDGKVIYLGVGDLNNNVLKHTRKNLLEQVLVMIHEIFPDEDNLSVELITGLPPTQMFNEKYLKLFQDIFIQPGEIKITIDGKQKTFEILNVDVKAEGYSGFISLVDKITTKQNILGIDVGGSTTDLCNYEYDYEDDMYYPNVTDTIEKGIIDFETAIANKFNSKNGADIKISQIDVILRNDIDVIEYEGSKYKLDDYIDAMYPIIDDMINKITNKFGQLDGYYVVGIGGGYKTFNKYANQFISKQLEVDDDSRFYANVIGYLEQ

SEQ ID NO: 307 - protein, 341 aa, Bacillus cereus
MKSLYAIDVGIGFTKRAYRQGEDSEVTVKSEASTLAPVPNHDESEDLTKVSFIDLDFAYYMGNEAHQSNASFLPPFEEEIENYYESEQFKQQIFGCIAKDYKENVVLPLVVTGLPVTYFGSQHEQLQRALKKETSVQIDGKFIHITVENALILQQPVALHAYFLKEGIIQERDRILIIDGGFRTLEMTDMKQNVILNHYETELGCSKPLKNIKNIVQNHAGESDHLHINDMPNILEKGYGGREENPQASQVDTLIQKELDTHFQDVMCVLQEQFKLDQYDTIIWTGGIVDIHKKRIEKMQGEISSFRMVDASKEAALHGYYMIGSQVFDDITNQSVYESKL

SEQ ID NO: 308 - protein, 340 aa, Citrobacter sp.
MSNDKLVVCGIDIGYSNVKIAVGDPADDKPTVSIYPAYATNEAVEDVRLVKRNCEHEVLVYPGGKEWRAFTERPDARELHDRYHMTEMYLALYLASLDKIAAKSGNDIDLVVTGLPVRLANDSERAKLTARLTGTFTIAPGKTVTVKKCLVLQQGVGVINDIVNRPGLISQEELEKATILVVDPGFFSMDYIAFKSGSRVSGSSGSSLKATSAIIESIVNRLNAVNPEERIDDLPEIIEIALRNNEPSFFNGFRHIPLRPLLEEAIPSIASDVVKELRKSTRVLGPVHIIAAAGGGTGFYEQTIREEFPRARIVSSPLPVASNAIGFWNYGVDLMLYGDD

SEQ ID NO: 309 - protein, 349 aa, Lactobacillus gasseri
MEIFSLDLGNKQTKLKSSKSEYVLPSRYLNQADMPMSVGSSTTNNDLHIYSVPFSDDKYVWGRDIDGLHLDEYLADTIMYGDRYNSEAFKLLANFALGLLASDFKIANNQVLEVVVTAGLPTGDYADHERLKSLLKVLEGQHQVTIDDQIVTVRVRKVYILPQPIGTLYNELLDSQGFIKNKALLDEKVGIVDVGGGTILIDTILNFELSGKNRQQFNTGVNDLYEAIASRIEGDVSLYQLEKELRHGNQQHQWSYRFSKNRQDDITELVGKESNRFTRRLVANVTSTLKNLDSIDTLFFTGGGANLINQKILKTTFTNAVIVKDTEVANVNGFYKYGLSQQAQDKEGK

SEQ ID NO: 310 - protein, 349 aa, Lactobacillus ultunensis
MEIFSLDLGNKQTKLKSSKSEYVLPSRYLNQADMPMSVGSSATNNDLHTYSVPFSDDKYVWGRGIDGLHLDEYLADTIMYGDRYNSEAFKLLANFALGLLASDFKIANNQVLEVVVTAGLPTGDYADHERLKSLLKVLEGQHQVTIDDQIVTVRVRKVYILPQPIGTLYNELLDSQGFIKNKALLDEKVGIVDVGGGTILIDTILNFELSGKNRQQFNTGVNDLYEAIASRIEGDVSLYQLEKELRHGNQQHQWSYRFSKNRQDDITELVGKESDRFTRRLVANVTSTLKNLDSIDTLFFTGGGANLINQKILKTTFTNAAIVKDTEVANVNGFYKYGLSQQAQEKEGK

SEQ ID NO: 311 - protein, 317 aa, Denitrovibrio acetiphilus
MIGIDVGYGDVKAVYVEDGELKYFKLPTAVAYAPSNSIDIIDSAEVVYSFQGREYIVGESARFGAFSTRSFDFLKRYSPLFIHHTLKVLKIEPTHVATGLPLGLFNRKDEMTKELITAQVDGNTIKAEFSMFPQAVGILLDYRMDDAGKVKADTAKNGIVLDIGFNTIDVLCFEKGTAIRSDAKTLDKFGISKIVLELVELINREHGIQLSDQEAKDVFLAGQMNVYGSRIDLTEAIRNITEMYFDEVMHNIRSLWDKRLQRADLLLLAGGGAVTIAKYVPSEYAKIVKVPERSEFANARGYFKALMAKQEQALKAD

SEQ ID NO: 312 - protein, 318 aa, Denitrovibrio acetiphilus
MIGIDVGYGDVKAVYMDVGELKYFKLPTAVAYAPMNSIDIADEAEERYSFQGREYIVGESARFGAFSTRSFDFLKKYAPLFIHHTLKVLRLVPSYVATGLPLGLFNRKDEMTKELTTAQVDGNTIKAEFSMFPQAVGILLDYRMDDAGKVKADTAKNGIVSDIGFNTIDVLCFEKGTAIRSDAKTLDKFGISKIVLELVELINREHGIQLSDQEAKDVFLAGRMNVYGNKIDLTEAIRNITEMYFDEVMHNIRSLWDKRLQRADLLLLAGGGAVTIAKYVPSEYAKIVKVPERSEFANARGYLKALMAKQEQALKADK

SEQ ID NO: 313 - protein, 408 aa, Lactobacillus salivarius
MSKNNVVKMNVANDLGYGSVKAKVNDTKIHFPSVLALQREQDIAKPVEFDSEKEKLSYLSDMINHMDITVSSSAVKTQGRFLLGTAAVKSSLPMRAFDVNDFTGKSDNDLSIILTLGMIAAQRVALAVENGEDLSEQLNAEVNMTTALPVSEGKKNGIVDSYINKYVNSKHTVVFHNLKDPITVSLTFNKVYVALEGEVAQLYIQNSDIKLKGLIKKDFAKNYPELATEIEVTDLVKIKNLLGIDIGEGTTDLVVIKDGKANAVSSTSLPTGYGNALQDAIDVLQTQNMNFEARSQLQDYLSQDVSPLAKRMQNKVRQTVFEQLAPFADKIVEAASKTMRKAGANVEVLYVYGGGSIPMLEQTELRQKLAQKMKDFSGGIDVPVIWIDKSYAQILNEKGLELVLNVLK

SEQ ID NO: 314 - protein, 342 aa, Lactobacillus salivarius
MEIFSLDLGNKQTKLKSSKNEYVLPSQILNGEDMPQQLSDFGKKRDINYFKVPFDDSEWIWGKDLSTLKRDDYLQDTLMHQNRYSNDTFKLLANFALGLLATDFEKAVENILEVTVVTGLPTDDYNSQKQLKDLSSILKGQHQIEVDGVTYTVRVKHVLIIPQPVGTFYDVLLDDEGVLVNDELLEEKVGIVDAGGGTILIDTLLNFELDKRNRRQYATGANDLYEAIMSQMDGNVSLYQIEKMVRNGIKERKFSYRYSKNHIEDVTDLVEKEITNFTRRLVSNLKSTFKDIDSIDTLIITGGSANLINQRLIVDFFETAYFVKDSELANVRGFYKYALTAE

SEQ ID NO: 315 - protein, 317 aa, Alicyclobacillus acidocaldarius
MIVGLDVGFGHLKWTTDGHTVHRMPAVAAPTWTEPDVVSGDHAWVVGEHAEREDATLAVALDHERLSRPEFQALLGYVFATLPDEPLQVVSGLPYSATEEEQANYERQLREIVGPYQVGERVWKGPVPSVTLFRQAQAALIDALFDERNRPRRPELLQEGLRIALIDVGYKTTDVVVAVLFPAYQIVREMSLSLDVGVHNVEAMLQRAYQRAYGAEMLDRERMRLALDGKRIYRFGQPVTLPVDEARRQVAERIRAGVVQHWGRAISTVARVFLAGGGAALLGAYLAQPPLVAEMVPDPQGANARGFYKLGRFAETA

SEQ ID NO: 316 - protein, 347 aa, Alicyclobacillus acidocaldarius
MLTIGLDVGNGSIGLCVRDGDTLVQDTTPSVYGRVDPTRQVLSVPGKSAPRKVDVFTFGGEHFVLGYKNVHAMHSTPIGAYDREQRYASRQFETLAKLALLDAATRTGRTGVIEVVVACGTPSEDFTTRTVEIMQRWFSEPVTGAKNGEQVVVMIKRLEVIPQPFGVFLDAYLDQDGLVVDEELEKQDVLVIDSGSGTLDLSEIHRLELTRQTSIPAGLNDVYQLILEEIRREEPKVYATAYDLEAQLRAQDGAQEFWFEYGALRMNITNLRERAMRQVWDRMQQGIQYAYPDRSSFGRVILAGGSGEAFRNYFLAWMPSIRIAPEPQLAVARGLYKYALAQGAEES

SEQ ID NO: 317 - protein, 338 aa, Alicyclobacillus acidocaldarius
MVIGVDLGYGWVKATNGERSNRFPALVGEAHELLLSDLFGVPEYDVHIETPFGSRRVFVGELARQESQAAWNLATKKFEDTDTEALWLTALALFARDGEPLDVVTGLPLAHYEAQRAALRERLLSLRGRVTIQGRIVEVEARSVRVIPQAMGAMIASLLDPATLELRNPAWTEHGGYLLLVDVGTRTTGFVTFETQPELRLMNRLSDSVDVGVHDLYVALASVFRQRTGETPPLSDGLYDELYARGEVFYGGHTVSVEPERSRHIERMGGLIVRRIQEHLGAEALKRVHTVFVAGGGYRIVQTTLQRMFPRVVVVPNPQMANAEGYRLYGLTRAGSGR

SEQ ID NO: 318 - protein, 341 aa, Bacillus cereus
MKSLYAIDVGIGFTKRAYRQDVDSEVTIKSEASTLAPVPNHDESEDLTKVSFIDLDFAYYMGNEAHQSDASLLPPFDEEIENYYESERFKQQIFGCIAKDYKENVVLPLVVTGLPVTYFGSQHEQLQRALKKETSVQIDGKFITITVENALILQQPVALHAYFLKEGIIQEQDRILIIDGGFRTLEMTDMKQNVILNHYETELGCSKPLKNIKNIVQNHAGESNQLHINDMPNILEKGYGGREEDPQTSQVHTLIQKELDAHFQDVMRVLQEQFKLDQYDTIIWTGGIVDLHKKRIEKIQGEISSFRMVDASKEAALHGYYMIGSQVFDDITNQSVYESKL

SEQ ID NO: 319 - protein, 341 aa, Bacillus cereus
MKSLYAIDVGIGFTKRAYRQDVDSEVTIKSEAATLAPVPNHAESEDLTKVSFIDLDFAYYMGNEAHQSDASFLPPFEEEIENYYESEEFKQQIFGCIAKDYKENVVLPLVVTGLPVTCFGSQHEQLQCALKKETSVQIDGKFINITVENALILQQPIALHAYFLKEGIIQEQDRILIIDGGFRTLEMTDMKQNLILNHYETELGCSKPLKNIKNILQNHAGESNQLHINDMPKILEKGYGDKEENYETSQVDILIQKELDTHFQDIMRVLQEQFKLDQYDTIIWTGGIVDLHKKQIEKMQGEIVSFRMVDASKEAALHGYYIIGSQVFEDITNQSAYKSKL

SEQ ID NO: 320 - protein, 343 aa, Bacillus cereus
MLLGNPYAIDLGNGFTKRASKKNKSLEADVITELSVLAPVDDYYNEASFTKIELTNTDFPYYIGEEARKSKLPLIRALGENKAKRYEDPTFKKQLFGFIAKDFKKNVTIPLLVTGLPVSHFGNQRESIRKVAMEETAVKVNGELITVKVKECLVIPQPVGTQYYLVKKEIINKEDRILIIDGGFGTFDVTDMSGNAVIDRLGTELGCEKAFMAIEQIVRDNIGETPDLSVSNMHYILENGYKYNGSLYDLYTHKDVAEKVDEELQRHFDAALREVSQKFNLAVYDKIVWTGGMAALHKKRIEKKKEQFPTFAVLENGQEANLLGYYYLGCDVFDKLTKEKASN

SEQ ID NO: 321 - protein, 341 aa, Bacillus cereus
MKSLYAIDVGIGFTKRAYRQDVDSEVTIKSEAATLAPVPNHAESEDLTKVSFIDLDFAYYMGNEAHQSDASFLPPFDEEIENYYESEEFKQQIFGCIAKDYKENVVLPLVVTGLPVTCFGSQHEQLQRALKKETSVQIDGKFINITVENALILQQPIALHAYFLKEGIIQEQDRILIIDGGFRTLEMTDMKQNVILNHYETELGCSKPLKNIKNILQNHAGESNQLHINDMPKILEKGYGDKEENYETSQVDILIQKELDTHFQDIMRVLQEQFKLDQYDTIIWTGGIVDLHKKQIEKMQGEIVSFRMVDASKEAALHGYYIIGSQVFEDITNQSAYKSKL

SEQ ID NO: 322 - protein, 341 aa, Bacillus cereus
MKSLYAIDVGIGFTKRAYRQDVDSEVTIKSEASTLAPVPNHAESEDLTKVSFIDLEFAYYMGNEAHQSDASFLPPFDEEIESYYESEQFKQQIFGCIAKDYKENVVLPLVVTGLPVTYFGSQHEQLQNVLKKETSVQIDGKFINITVENVLILQQPVALHAYFLKEGIIQEQDRILTIDGGFRTLEITDMKQNVILNHYETELGCSKPLKNIKNILQNHAGESDDLHINDMPKILEKGYGGREENHQTSQVDTLIQKELDTHFQDVMRVLQEQFKLDQYDTIIWTGGIVDIHKKRIEKMQGEISSFRMVDASKEAALHGYYIIGSQVFEDITNQSAYESKL

SEQ ID NO: 323 - protein, 389 aa, Bacillus cereus
MSILLKAGADAGNNGLKLMVKGQDPIFIPSIYSLYIGEPTGLLDESDVSLSELENHIDVTISSPSLMLNNVRYIVGEKVIQDQLKGTEVEKKSNKSTDELMVITILSGLAVSAMRQSPTSGHINIRYDLSVALPMQLITQEIAAENAKRYMGNHKVVFHYPNGRDVTINISIEYCKCLPEGASGTWGIVYDEEGNVVKHKIECEQNQVSEIDFVDKTLLSFDIGAGTTEEVVSLGVNFRPQLSKGLSYGVKETLLQIITRWNRKYPTKTIDSITEFNQIYLHEKHPRNALLVEESQPALLGLAARVATDIINKIDDMKDDPYVFIYGGGAVIIKNSLKMILKQKGRLTNVIFVDNPLFTNARGLLVYTCSPKYREHKQKELGFTNLTIS

SEQ ID NO: 324 - protein, 388 aa, Bacillus cereus; identical to SEQ ID NO: 6

SEQ ID NO: 325 - protein, 389 aa, Bacillus cereus
MSILLKAGADAGNNGLKLMVKGQDPVFIPSIYSLYIGEPTGLLDEGDVSLSELENHIDVTISSPSLMLNNVRYIVGEKVIQDQLKGTEVEKKSNKSTDELMVITILSGLAVSAMRQSPTSSHINIRYDLSVALPMQLITQEIAAENAKRYMGNHKVVFHYPNGRDVTINISIEYCKCLPEGASGTWGIVYDEEGNVVKHKIECEQNQVSEIDFVDKTLLSFDIGAGTTEEVVSLGVNFRPQLSKGLSYGVKETLLQIITRWNRKYPTKTIDSITEFNQIYLNEKHPRNALLVEESQPALLGLAARVATDIINKIDDMKDDPYVFIYGGGAVIIKNSLKMILKQKGRLTNVIFVDNPLFTNARGLLVYTCSPKYREHKQKELGFTNLTIS

SEQ ID NO: 326 - protein, 341 aa, Bacillus cereus
MKSLYAIDVGIGFTKRAYRQDVDSEVTIKSEASTLAPIPNHAESEDLTKVSFIDLDFAYYMGNEAHQSDASFLPPFDEEIENYYESEQFKQQIFGCIAKDYKENVVLPLVVTGLPVTCFGSQHEQLQRALKKETSVQIDGKFITITVENVLILQQPVALHAYFLKEGIIQEQDRILIIDGGFRTLEMTDMKQNVILNHYETELGCSKPLKNIKNILQNHAGESGHLHINDMPKILEKGYGGREENHQTSQVDTLIQKELDTHFQDVMRVLQEQFKLDQYDTIIWTGGIVDIHKKRIEKIQGEISSFRMVDASKEAALHGYYMIGSQVFDDITNQSVYESKL

SEQ ID NO: 327 - protein, 389 aa, Bacillus cereus
MSILLKAGADAGNNGLKLMVKGQEPVFIPSIYALYIGEPTGLLDEVDVSLSELENHIDVTISSPSLMLNNVRYIVGEKVIQDQLKGTEVEKKSNKSTDELMVITILSGLAVSAMRQSPTSSHINIRYDLSVALPMQLITQEIAAENAKRYMGNHKVVFHYPNGRDVTINISIEYCKCLPEGASGTWGIVYDEEGNVVKHKIECEQNKVSEIDFVDKTLLSFDIGAGTTEEVVSLGVNFRPQLSKGLSYGVKETLLQIITRWNRKYPTKTIDSITEFNQIYLNDKHPRNALLVEESQPALLGLAARVATDIINKIDDMKDDPYVFIYGGGAVIIKNSLKMILKQKGRLTNVIFVDNPLFTNARGLLVYTCSPKYREHKQKELGFTNLTIS

SEQ ID NO: 328 - protein, 341 aa, Bacillus cereus
MKSLYAIDVGIGFTKRAYRQDVDSEVTIKSEAATLAPVPNHAESEDLTKVSFIDLDFAYYMGNEAHQSDASFLPPFEEEIENYYESEEFKQQIFGCIAKDYKENVVLPLVVTGLPVTCFGSQHEQLQHALKKETSVQIDGKFINITVENALILQQPVALHAYFLKEGIIQERDRILIIDGGFRTLEMTDMKQNLILNHYETELGCSKPLKNIKNILQNHAGESNQLHINDMPKILEKGYGDKEENYETSQVDILIQKELDTHFQDIMRVLQEQFKLDQYDTIIWTGGIVDLHKKQIEKMQGEIVSFRMVDASKEAALHGYYIIGSQVFEDITNQSAYESKL

SEQ ID NO: 329 - protein, 343 aa, Bacillus cereus
MLLGNPYAIDLGNGFTKRASKKNKSLEADVITELSVLAPVDDYYNEASFTKIELTNTDFPYYIGEEARKSKLPLIRALGENKAKRYEDPTFKKQLFGFIAKDFKKNITIPLLVTGLPVSHFGNQRESIRKVAMEETAVKVNGELITVKVKECLVIPQPVGTQYYLVKKEIINKEDRILIIDGGFGTFDVTDMSGNAVIDRLGTELGCEKAFMAIEQIVRDNIGETPDLSVSNMHYILENGYKYNGSLYDLYTHKDVAEKVDEELQRHFDSSLREVSQKFNLAVYDKIVWTGGMAALHKKRIEKKKEQFPTFAVLENGQEANLLGYYYLGCDVFDKLTKEKASN

SEQ ID NO: 330 - protein, 384 aa, Bacillus cereus; identical to SEQ ID NO: 7

SEQ ID NO: 331 - protein, 371 aa, Bacillus cereus
MFLTASVDAGNDALKAYIGGLEEENKVYIPNVVKKMEDRPILSLGDDPLAELHLRITSSAINISGTYAVGTLAVKEKDSSHIPATVMKSDSDQTVILALTALAYYAAMNSKAKKVDVEYLLSSGLPVDEVKADRRASFKEKLVEGTHVIEFKKTPLLEGKTVNIKFRDAFMNVEGFAAMVNLTVDDKLQAINNDLKQKNILLNDMGGNTTDKAVIRMGRIDNEYSSGSPLGIGEYLDAIKKEVFTTFRVDVFKSRRQLVENMTAEKEAYVIRPHGKAESYQAIAEKHLMEFAMREYADLVEKWKEVGDLHCIYNVGGSAAIAKPFLEQINKENNQFEMYFLDTEESIWSIAKAYYKLLLIIAKQKGLDLKK

SEQ ID NO: 332 - protein, 341 aa, Bacillus thuringiensis
MKSLYAIDVGIGFTKRAYRQDEDSEVTVKSEASTLAPVPNHDESEDLTKVSFIDLDFAYYMGNEAHQSDASFLPPFEEEIENYYESEQFKQQIFGCIAKDYKENVVLPLVVTGLPVTYFGSQHEQLQRALKKETSVQIDGKFIHITVENALILQQPVALHAYFLKEGIIQERDRILIIDGGFRTLEMTDMKQNVILNHYETELGCNKPLKNIKNIVQNHAGESNQLHINDMPNILEKGYGGREENPQASQIDTLIQKELDTHFQDVMCVLQEQFMLDQYDTIIWTGGIVDLHKKRIKKMQGEISSFRMVDASKEAALHGYYMIGSQVFDDITNQSVYESKL

SEQ ID NO: 333 - protein, 341 aa, Bacillus cereus
MRSLYAIDVGIGFTKRAYRQDVDSEVTIKSEASTLAPVPNHAESEDLTKVSFIDLDFAYYMGNEAHQSDASFLPPFDEEIENYYESERFKQQIFGCIAKDYKENVVLPLVVTGLPVTCFGSQHEQLQRALKKETSVQIDGKFINITVENALILQQPVALHAYFLKEGIIQERDRILIIDGGFRTLEMTDMKQNVILNHYETELGCSKPLKNIKNIMQNHGGESNHLHINDMPKILEKRYECREENPQTKQVHTLIQKELDAHFQDVMRVLQEQFKLEQYDTIIWTGGIVDLHKKRIEKMQGEISSFRMVDASKEAALHGYYIIGSQVFEDITNQSAYESKL

SEQ ID NO: 334 - protein, 341 aa, Bacillus cereus
MKSLYAIDVGIGFTKRAYRQDVDSEMTIKSEASTLAPVPNHAESEDLTKVSFIDLDFAYYMGNEAHQSDASFLPPFDEEIENYYESERFKQQIFGCIAKDYKENVVLPLVVTGLPVTCFGSQHEQLQRALKKETSVQIDGKFIHIKVENALILQQPVALHAYFLKEGIIQERDRILIIDGGFRTVEMTDMKQNVILNHYEAELGCSKPLKNIKNIVQNHEGESNQLHINDMPNILEKGYECREENHETSQVHTLIQKELDAHFQDVMRVLQEQFKLEQYNTIIWTGGIVDLHKKRIEKMQSEISSFRMVDASKEAALHGYYIIGSQVFEDITNQSAYESKL

SEQ ID NO: 335 - protein, 388 aa, Bacillus cereus; identical to SEQ ID NO: 8

SEQ ID NO: 336 - protein, 341 aa, Bacillus cereus
MRSLYAIDVGIGFTKRAYRQDVDSEVTIKSEASTLAPVPNHAESEDLTKVSFIDLDFAYYMGNEAHQSDASFLPPFDEEIENYYESERFKQQIFGCIAKDYKENVVLPLVVTGLPVTCFGSQHEQLQRALKKETSVQIDGKFINITVENALILQQPVALHAYFLKEGIIQERDRILIIDGGFRTLEMTDMKQNVILNHYETELGCSKPLKNIKNIMQNHGGESNHLYINDMPKILEKRYECREENPQTKQVHTLIQKELDAHFQDVIRVLQEQFKLEQYDTIIWTGGIVDLHKKRIEKMQGEISSFRMVDASKEAALHGYYIIGSQVFEDITNQSAYESKL

SEQ ID NO: 337 - protein, 341 aa, Bacillus cereus
MKSLYAIDVGIGFTKRAYRQDKDSEVTIKSEASTLAPVPNHDESEDLTKVSFIDLDFAYYMGNEAHQSDASFLPPFEEEIENYYESEQFKQQIFGCIAKDYKENVVLPLVVTGLPVTYFGSQHEQLQRALKKETSVQIDGKFIHITVENALILQQPVALHAYFLKEGIIQERDRILIIDGGFRTLEMTDMKQNVILNHYETELGCSKPLKNIKNILQNHAGESNQLHINDMPNILEKGYGGREENPQASQVHTLIQKELDTHFQDVMCVLQEQFMLDQYDTIIWTGGIVDLHKKRIEKMQGEISSFRMVDASKEAALHGYYMIGSQVFDDITNQSVYESKL

SEQ ID NO: 338 - protein, 373 aa, Bacillus cereus; identical to SEQ ID NO: 9

SEQ ID NO: 339 - protein, 341 aa, Bacillus cereus
MKSLYAIDVGIGFTKRAYRQDVDSEVTIKSEAATLAPVPNHAESEDLTKVSFIDLDFAYYMGNEAHQSDASFLPPFDEEIENYYESEEFKQQIFGCIAKDYKENVVLPLVVTGLPVTCFGSQHEQLQRALKKETSVQIDGKFINITVENALILQQPIALHAYFLKEGIIQEQDRILIIDGGFRTLEMTDMKQNVILNHHETELGCSKPLKNIKNILQNHAGESNQLHINDMPKILEKGYGDKEENYETSQVDILIQKELDTHFQDIMRVLQEQFKLDQYDTIIWTGGIVDLHKKQIEKMQGEIVSFRMVDASKEAALHGYYIIGSQVFEDITNQSAYKSKL

SEQ ID NO: 340 - protein, 341 aa, Bacillus cereus
MKSLYAIDVGIGFTKRAYRQDVDSEVTIKSEASTLAPVPNHAESEDLTKVSFIDLDFAYYMGNEAHQSDASFLPPFDEEIENYYESERFKQQIFGCIAKDYKENVVLPLVVTGLPVTCFGSQHEQLQRALKKETSVQIDGKFINITVENVLILQQPVALHAYFLKEGIIQERDRILIIDGGFRTLEMTDMKQNLILNHYETELGCSKPLKNIKNIMQNHAGESNHLHINDMPKILEKGYGGREENPQTKQVDTLMQKELDVHFQDVMRVSQEQFKLEQYDTIIWTGGIVDLHKKRIEKMQGEISSFRMVDASKEAALHGYYIIGSQVFEDITNQSAYESKL

SEQ ID NO: 341 - protein, 341 aa, Bacillus cereus
MKSLYAIDVGIGFTKRAYRQDVDSEVTIKSEAATLAPVPNHAESEDLTKVSFIDLDFAYYMGNEAHQSDASFLPPFDEEIENYYESEEFKQQIFGCIAKDYKENVVLPLVVTGLPVTCFGSQHEQLQRALKKETSVQIDGKFINITVENALILQQPIALHAYFLKEGIIQEQDRILIIDGGFRTLEMTDMKQNVILNHYETELGCSKPLKNIKNILQNHEGESNQLHINDMPKILEKGYGDKEENYETSQVDILIQKELDTHFQDIMRVLQEQFKLDQYDTIIWTGGIVDLHKKQIEKMQGEIVSFRMVDASKEAALHGYYIIGSQVFEDITNQSAYKSKL

SEQ ID NO: 342 - protein, 345 aa, Bacillus cereus
MLLGNPYAIDLGNGFTKRASKKNKELEAAVITELSVLAEVDDYYNEASFTKIELTNIDSPYYIGEEARKSKLPLVRALGENKAKRYEDPIFKKLLFGFIAKDFKKSKHISLPLLVTGLPVSHFGNQRETLEKVITTETSMKVNGEMITVDVKKCLVIPQPVGTQYYLVKKNIIEKDDRILIIDGGFGTLDVTDMSGNSVIGRLGTELGCEKAFLNIEQIVRDNIGETPELSVSNMHYILENSYKYNGNSHNLYKDDKVSEKVESELKHHFASVLREVSQKFNFAVYDKIIWTGGMASLHKALIIEQQTKFPTFELLENGQEANLLGYYYLGDDVFDKITKEKAAN

SEQ ID NO: 343 - protein, 341 aa, Bacillus cereus
MKSLYAIDVGIGFTKRAYRQDVDSEMTIKSEASTLAPVPNHAESEDLTKVSFIDLDFAYYMGNEAHQSDASFLPPFDEEIENYYESERFKQQIFGCIAKDYKENVVLPLVVTGLPVTCFGSQHEQLQRALKKETSVQIDGKFIHITVENALILQQPVALHAYFLKEGIIQERDRILIIDGGFRTVEMTDMKQNVILNHYEAELGCSKPLKNIKNMVQNHEGESNQLHINDMPNILEKGYECREENHEASQVHTLIQKELDAHFQDVMRVLQEQFKLEQYNTIIWTGGIVDLHKKRIEKMQSEISSFRMVDASKEAALHGYYIIGSQVFEDITNQSAYESKL

SEQ ID NO: 344 - protein, 343 aa, Bacillus cereus
MLLGNPYAIDLGNGFTKRASKKNKDLEAAVVTELSVLAPVDDYYNEAEFTKIELTNTDFPYYIGEEARKSKLPLVRALGENKAKRYEDPTFKKQLFGFIAKDFKKNVTIPLLVTGLPVSHFGNQRESLQKVAMEETAVKVNGELITIKVKQCLVIPQPVGTQYYLVKKEIIKKEDRILIIDGGFGTFDVTDMSGNAVIDRLGTELGCEKAFMTIEQIVRDNIGETPDLSVSNMHYILENGYKYNGSLYDLYTHKDVAEKVDAELQRHFDAALREVSQKFNLAVYDKIVWTGGMAALHKKRIEKKKEQFPTFAVLENGQEANLLGYYYLGCDVFDKLTKEKASN

SEQ ID NO: 345 - protein, 341 aa, Bacillus cereus
MKSLYAIDVGIGFTKRAYQQDVDSEVTIKSEASTLAPVPNHAESDDLTKVSFIDLDFAYYMGNEAHQSDAAFLPPFDEEIENYYESEQFKQQIFGCIAKDYKENVVLPLVVTGLPVTCFGSQHEQLQRALKKETSVQIDGKFIHITVENALILQQPVALHAYFLKEGIIQERDRILIIDGGFRTLEITDMKQNVILNHYETELGCSKPLKNIKDILQNHAGESNQLHINDMPNILEKGYGGREENHQTSQVDTLIQKELDAHFQDVMRVLQEQFKLDQYDTIIWTGGIVDIHKKRIEKMQGEISSFRMVDASKEAALHGYYMIGNQVFDDITNQSAYESKL

SEQ ID NO: 346 - protein, 389 aa, Bacillus cereus
MSILLKAGADAGNNGLKLMVKGQDPIFIPSIYSLYIGEPTGLLDEGDVSLSELENHIDVTISSPSLMLNNVRYIVGEKVIQDQLKGTEVEKKSNKSTDELMVITILSGLAVSAMRQSPTSSHINIRYDLSVALPMQLITQEIAAGNAKRYMGNHKVVFHYPNGRDVTINISIEYCKCLPEGASGTWGIVYDEEGNVVKHKIECEQNQVSEIDFVDKTLLSFDIGAGTTEEVVSLGVNFRPQLSKGLSYGVKETLLQIITRWNRKYPTKTIDSITEFNQIYLHEKHPRNALLVEESQPALLGLAARVATDIINKIDDMKDDPYVFIYGGGAVIIKNSLKMILKQKGRLTNVIFVDNPLFTNARGLLVYTCSPKYREHKQKELGFTNLTIS

SEQ ID NO: 347 - protein, 407 aa, Bacillus mycoides; identical to SEQ ID NO: 10

SEQ ID NO: 348 - protein, 396 aa, Bacillus pseudomycoides
MKLNYFVEDDNGNSEKKITINGEMMKFPNTYSYVYKDPVPQDKKIEELVHGLIRNMDVTVNSSALKGQVAQRIFVGERAIRSGADLQNLNIRSNRGKHKQDTTIMTTVSAIACRAVQDMFNKENSLEEGTNVEVNVLMVTALPASEWTKEKAKQLSDRFTNSSHHVTVTVGDVRIYVTLKFDKVIVVQEGTVALFALIEDGKGNYRDDDLFNEFKEMYNLKNITGEYFQEKRLLHIDIGDGTTEYVVTKGYDYDNDHSSGERHGIGHAIERAKKDFEDEWGFSVERQEFAGYLKEVHPKYYDDAKKFLARAKFNLADEVLDTAETKLQDLKYDVDVVCVYGGGSIQLKENLFEELKEICDSKKIKILWINPKNATEMNVKGMTVFSSIALQTEQVN

SEQ ID NO: 349 - protein, 407 aa, Bacillus pseudomycoides; identical to SEQ ID NO: 11

SEQ ID NO: 350 - protein, 341 aa, Bacillus thuringiensis
MKSLYAIDVGIGFTKRAYRQDVDSEVTIKSEASTLAPVPNHAESEDLTKVSFIDLDFAYYMGNEAHQSDASFLPPFDEEIEHYYESEQFKQQIFGCIAKDYKENVVLPLVVTGLPVTCFGSQHEQLQRALKKETSVQIDGKFITITVENALILQQPVALHAYFLKEGIIQERDRILIIDGGFRTLEMTDMKQNVILNHYETELGCSKPLKNIKNIVQNHAGESNQMHINDMPNILEKGYGGREEDPQTSQVDTLIQKELDAHFQDVMRVLQEQFKLEQYDTIIWTGGIVDLHKKRIEKIQGEISSFRMVDASKEAALHGYYMIGSQVFDDITNQSVYESKL

SEQ ID NO: 351 - protein, 423 aa, Bacillus thuringiensis
MVEQMLSKNMLLGGFDTGNIKAKISFLNEKGNIESFAIPTVIAEAPPAKIDLKSAPSKKNDYVNEKDEDIELLHVRIISNSLDGDARSRAWYVGAYAKDQEDRQEPTVDEMGKTEDKFSQKNKKLHLIPLFTSMAVAAARIGKEEVFVPFSGGMPIEDYKLRGEEQILEMLYGEHTVEFLDGTYEGKKIKITINDGTMNVEGVSSVLAILFDIVNGEIVEVEGMDAEIGESYAINDLGAGTSDNAFFEDGELNKKLSTNTDLGTNKYIDEILKNIKERFMENEILKSFMTDEIESPFKTREDFIQRLVMPEVEKMIEDDTYKPTFSVKWGPVKENVTDIVMDGMLKYAEDQKASLMKFWFKTNADKNIVVGGGVLFGYAGLRDLKEQDGFILPKNIQESAYFTSRSYLIANLLEQLNKEGVEA

SEQ ID NO: 352 - protein, 341 aa, Bacillus thuringiensis
MKSLYAIDVGIGFTKRAYRQAVDSEMTIKSEASTLAPVPNHAESEDLTKVSFIDLDFAYYMGNEAHQSDASFLPPFDDEIENYYESERFKQQIFGCIAKDYKENVVLPLVVTGIPITCFGSQHEQLQRALKKETSVQIDGKFIHITVENALILQQPVALHAYFLKEGIIQERDRILIIDGGFRTLEMTDMKQNLILNHYETELGCSKPLKNIKNIVQNYEGESNQLHINDMPNILEKGYECREENHETSQVHTLIQKELDAHFQDVIRVLQEQFTLEQYDTIIWTGGIVELHKKRIEKMQSEISSFRMVDASKEAALHGYYIIGSQVFDDITNQSAYESKL

SEQ ID NO: 353 - protein, 327 aa, Bacillus thuringiensis
MDLMEIKTYSIDLGNGYTKRIVNGECIVEPSVIADVESYFSDDVDVTTLQLSEGEAYFTGDDVGILGLKPISALGEHDMDRYETPEFKKMIFGFLAKDFKQDVTIERLVTGLPVQHFKTKGKIVEELLKGRTVVKVNDKDIIIDIKNVSIIPQPIGTYLHLVAKKAVTPNKDLTLIVDCGHGTLDVTELKGKTIVKRAGNNEGAKEAYINIYNTLVEEYGSLKELTISNIQNILLDGLLVSGSRINVRAKSEVQKILKKHFNSIFTFLQDNKFDLRSYDKVVFTGGIVHLYHDYFGERAEANFLVVEDGQTANARGYHEYGKAMTKK

SEQ ID NO: 354 - protein, 315 aa, Bacillus thuringiensis
MGNGYTKRIVNGECIVEPSVIADVESYFSDDVDVTTLQLSEGEAYFTGDDVGILGLKPISALGEHDMDRYETPEFKKMIFGFLAKDFKQDVTIERLVTGLPVQHFKTKGKIVEELLKGRTVVKVNDKDIIIDIKNVSIIPQPIGTYLHLVAKKAVTPNKDLTLIVDCGHGTLDVTELKGKTIVKRAGNNEGAKEAYINIYNTLVEEYGSLKELTISNIQNILLDGLLVSGSRINVRAKSEVQKILKKHFNSIFTFLQDNKFDLRSYDKVVFTGGIVHLYHDYFGERAEANFLVVEDGQTANARGYHEYGKAMTKK

SEQ ID NO: 355 - protein, 423 aa, Bacillus thuringiensis
MVEQMLSNNMLLGGFDTGNIKAKISFLNEKGNIESFSVPTVIAEAPPAKIDLKSAPSKKNDYVNEKDEDIELLHVRIISNSLDGDARSRAWYVGAYAKDQEDRHEPTVDEMGKTEDKFSQKNKKLHLIPLFTSMAVAAARIGKEEVSVPFSGGMPIEDYKLRGEEQILEMLYGEHTVEFLDGTYEGKKITITINDGTMNVEGVSSVLALLFDIVNGEIVEVEGMDAEIGESYAINDLGAGTSDNAFFEDGELNKKLSTNTDLGTNKYIDEILKNIKERFMENKILKSFMTDEIESPFKTREDFIQRLVMPEVEKMIEDDTYKPTFSVKWGPVKENVTDIVMDGMLKYAEDQKASLMKFWFKTNADKNIVVGGGVLFGYAGLRDLKEQDGFILPKNIQESAYFTSRSYLIANLLEQLNKEGVEV

SEQ ID NO: 356 - protein, 281 aa, Bacillus thuringiensis
MGNEAHQSDASLLPPFNEEIENYYESERFKQQIFGCIAKDYKENVVLPLVVTGLPVTCFGSQHEQLQHALKKETSVQIDGKFINITVENALILQQPVALHAYFLKEGIIQEQDRILIIDGGFRTLEMADMKQNLILNHYETELGCSKPLKNIKNILQNHAGESNQLHINDMPKVLEKGYECREENHETSQVHTLIQKELDAHFQDVIRVLQEQFTLEQYDTIIWTGGIVDLHKKRIEKMQSEISSFRMVDASKEAALHGYYIIGSQVFDDITNQSAYESKL

SEQ ID NO: 357 - protein, 338 aa, Bacillus thuringiensis
MKSPYAIDLGIGFTKRAYRKHVNSPTTIKSEASTLAPVPIEDESENLTKVSFMDVDFAYYMGEEAHQSEASFLPPFEEDIEHYYESNRFKQQLFGCIAKDYQENIVLPLVVTGLSLSCFGKQHEQLQKIIKKETSVQLDGKFITITVENALLLPQPIALHAYFVEESIIQERERVLIIDGGFRTLEITDMKQQLILNRYETELGCRKPLKKIENILREHVGESPTLHLHNLPDILDKGYICKEEIHCLQTSPISALVQKELNAHFQEILDVVQEQFLFHQYDKIIWTGGVVDMHKKRIQEKQGAYPSIHILEPAKEAALHGYYILGCRVFEDIVQQPV

SEQ ID NO: 358 - protein, 384 aa, Bacillus thuringiensis; identical to SEQ ID NO: 12

SEQ ID NO: 359 - protein, 407 aa, Bacillus thuringiensis
MMRTVADIGNSELKMVINGGKVIKLPDVNKRVFGRVTNKEGSLKQSVTNLMNEICVHVTSDAIERDGKFYVGYRAAHSNGKPDALDIELGDKYKRDIPVVNVLSVMATKAVQTIYEEVGELPKSIEVPASLILAIPASEYEGKKARFLESRFKENVHIVIVYVGEEKVTVQIKFETVKVTREGIPALYAIFEGNQDMFDDFNKLYKKETDSKEDDKEVKKRKANLMVEEEVNGEYFKNKKILHADIGDGTSEYIFSKGLNPVPDACWGEKRGIGHAIEGAIKLLQEEYEGGVDINRQQFSELVTDPNDKKHDKAVEFLEETRYMQAQGIYDDIEKAYVYKTASQAEVLAVYGGGSIALKEDLYKKAFEFCEVNDMQLLWISPTYATEMNVRGMEILSKKLASRVAKK

SEQ ID NO: 360 - protein, 341 aa, Bacillus thuringiensis
MKSLYAIDVGIGFTKRAYRQDVDSEMTIKSEASTLAPVPNHAESEDLTKVSFIDLDFAYYMGNEAHQSDASFLPPFDEEIENYYESERFKQQIFGCIAKDYKENVVLPLVVTGLPVTCFGSQHEQLQRALKKETSVQIDGKFIHITVENALILQQPVALHAYFLKEGIIQERDRILIIDGGFRTVEMTDMKQNVILNHYEAELGCSKPLKNIKNIVQNHEGESNQLHINDMPNILEKGYECREENPETSQVHTLIQKELDAHFQDVMRVLQEQFKLEQYNTIIWTGGIVDLHKKRIEKMQSEISSFRMVDASKEAALHGYYIIGSQVFEDITNQSAYESKL

SEQ ID NO: 361 - protein, 341 aa, Bacillus thuringiensis
MKSLYAIDVGIGFTKRAYRQDVDSEVTIKSEAATLAPVPNHAESEDLTKVSFIDLDFAYYMGNEAHQSDASFLPPFDEEIENYYESEQFKQQIFGCIAKDYKENVVLPLVVTGLPVTCFGSQHEQLQRALKKETSVQIDGKFINITVENALILQQPIALHAYFLKEGIIQEQDRILIIDGGFRTLEMTDMKQNVILNHYETELGCSKPLKNIKNILQNHAGESNQLHINDMPKILEKGYGDKEENYETSQVDILIQKELDTHFQDIMRVLQEQFKLDQYDTIIWTGGVVDLHKKQIEKMQGEIVSFRMVDASKEAALHGYYIIGSQVFEDITNQSAYKSKL

SEQ ID NO: 362 - protein, 370 aa, Bacillus thuringiensis
MKMLITAAIDAGNDALKALFNGFENKLYIPNVVKEMESRQVIELGDDPLKELHVHITSSALKKSATYAVGTLAAKEKQSAQIPATDLKSESDQTTILMLTALAYEAASNSDKDVIDAEFLLSTGLPVDEVKEDKRAGFKKKLLEGTHVVEFKKTPHLEGKKVRISFKDIFVNVEGFAAMINLTISEELKSQNSELRQKNILINDMGGNTTDKAVIRMGQIDNEYSSGSPLGIGEYLDAIRKEVFNTYRVDVFKSRRQLVENMTAKHEAYIIRPHGKPVSYYEIAEKHLKEFTVREYADLVDKWKEVGDLHSIHNVGGSAAIVKSFLEDINKNENQFEMHFLDTEESIWSIAKAYYKLLLVIAKQKELSLN

SEQ ID NO: 363 - protein, 365 aa, Bacillus thuringiensis
MDAGNDALKAFIGGLGEDHKVYIPNVIKKMDDRPILSLGDDPLSELHLRITSSAINISGTYAVGTLAVKEKDSSHIPATVLKSESDQTVILTLTALAYYAAMHSKAKKVDVEYLLSSGLPVDEVKADKRAAFKEKLIEGTHVIEFKKTPLLEGKTVNIKFRDAFMNVEGFGAVINLTVDDKLQAINNELKQKNILINDMGGNTTDKAVIRMGRIDNEYSSGSPLGIGEYLDAIKKEVFTTFRVDVFKSRRQLVENMTAEKEAFIIRPHGKAESYQAIAEKHLMEFAMREYADLVDKWKEVGDLHSIYNVGGSAAIAKPFLEQINKENNQFEMHFLDTEESIWSIAKAYYKLLLIIAKQKGLDLKK

SEQ ID NO: 364 - protein, 388 aa, Bacillus thuringiensis; identical to SEQ ID NO: 13

SEQ ID NO: 365 - protein, 341 aa, Bacillus thuringiensis
MKSLYAIDVGIGFTKRAYRQDEDSEVTVKSEASTLAPVPNHDESEDLTKVSFIDLDFAYYMGNEAHQSDASFLPPFEEEIENYYESEQFKQQIFGCIAKDYKENVVLPLVVTGLPVTYFGSQHEQLQRALKKETSVQIDGKFIHITVENALILQQPVALHAYFLKEGIIQERDRILIIDGGFRTLEMTDMKQNVILNHYETELGCSKPLKNIKNIVQNHTGESSHLHINDMPNILEKGYGGREENPQASQVGTLIQKELDTHFQDVMCVLQEQFMLDQYDTIIWTGGIVDLHKKRIEKMQGEISSFRMVDASKEAALHGYYMIGSQVFDDITNQSVYESKL

SEQ ID NO: 366 - protein, 429 aa, Bacillus thuringiensis
MEKAQLILDLGNSETRGVLRVGEIINKTRIEHNFYLSNYFSPIFEGVGGIPESDDYTEENSTVFTLDDDFKIGNGVVNRDTYVNGLMCSNEFSDTQDKPTAMTKKYDSSYTVLTIITAIKQSAIWMKDYFGKKGKNFSVQQLINEVAWELTILLPPSQEKAGGLVLQETLVGQIPVKFELPKADARINITKVTIRAEGMMAYTGVLLSKTRRQPRPNKIFMQKAKVMVLDIGAGTTDLIVIDQGKAIERSKYTIDLGGNNITQTLRTTVQTNLEIRLSAQVFEQGVITGKVKQGLKEHDVTDELIGAKRSVAAKISKEVKDYLESSGIEANSIEYILVVGGGSIPSENDKVKPISDYLLDSIKRFAPQVGLVDISDIITKPNSVAFENVADADFVSSRELNISGAGTVTDLLEIKQYLAQQEQAKQVQA

SEQ ID NO: 367 - protein, 336 aa, Bacillus thuringiensis
MTKVFAIDHGNGAVKMRTDVFKKTLPAIYSFSSNVGEALSGGKMKLKTYKVEGTEYVWGDDIIKVNNTLNTYAQQNRYKTNQYKTLSKIALAEMAAKTNVKSYDEILVVTGVPSQEIGTKAVDEIKEVYQGTHELEVNGKKVTLNVVDVIVLAQPVGTVMSRYLDEDGFVADDSYEDMTVGIIDIGTGTTDLDVISMLRREKESTSVPKGMHDVYEPIVAKIKKETSATINDYKLEKVFEEGAYQASKRMDPIDFNDEKTASIKEVYDFIVNGVNNAWKTFDRFDEVLVSGGGANTFHELLEEWIGKVTKLEESQTANVEGFYRYGKFEVGEEDGE

SEQ ID NO: 368 - protein, 341 aa, Bacillus thuringiensis
MKSLYAIDVGIGFTKRAYRQDVDSEMTIKSEASTLAPVPNHAESEDLTKVSFIDLDFAYYMGNEAHQSDASFLPPFDEEIENYYESERFKQQIFGCIAKDYKENVVLPLVVTGLPITCFGSQQEQLQRALKKETSVQIDGKFINITVENALILQQPVALHAYFLKEGIIQERDRILIIDGGFRTLEMTDMKQNLILNHYETELGCSKPLKNIKNIVQNHTDESNQLHINDMPNILEKGYECREENHETSQVHTLIQKELDAHFQDVMRVLQEQFKLEQYDTIIWTGGIVDLHKKRIEKMQGEISSFRMVDASKEAALHGYYIIGSQVFEDITNQSAYESKL

SEQ ID NO: 369 - protein, 341 aa, Bacillus thuringiensis
MKSLYAIDVGIGFTKRAYRQDEDSEVTVKSEASTLAPVPNHDESEDLTKVSFIDLDFAYYMGNEAHQSDASFLPPFEEEIENYYESEQFKQQIFGCIAKDYKENVVLPLVVTGLPVTYFGSQHEQLQRALKKETSVQIDGKFIHITVENALILQQPVALHAYFLKEGIIQERDRILIIDGGFRTLEMTDMKQNVILNHYETELGCSKPLKNIKNIVHNHAGESDHLHINDMPNILEKGYGGREEDPQTNQVHILIQKELDAHFQDVMRVLQEQFKLDQYDTIIWTGGIVDLHKKRIEKMQGEISSFRMVDASKEAALHGYYMIGSQVFDDITNQSVYESKL

SEQ ID NO: 370 - protein, 341 aa, Bacillus thuringiensis
MKSLYAIDVGIGFTKRAYRQDIDSEMTIKSEASTLAPVPNHTDSEDLTKVSFIDLDFAYYMGNEAHQSDASLLPPFDEEIENYYESERFKQQIFGCIAKDYKENVVLPLVVTGLPVTCFGSQHEQLQHALKKETSVQIDGKFINIKVKNALILQQPVALHAYFLKEGIIQEQDRILIIDGGFRTLEMADMKQNLILNHYETELGCSKPLKNIKNILQNHAGESNQLHINDMPNILEKGYECREENHETSQVHTLIQKELDAHFQDVMRVLQEQFKLEQYDTIIWTGGIVDLHKKRIEKMQGEISSFRMVDASKEAALHGYYIIGSQVFDDITNQSAYESKL

SEQ ID NO: 371 - protein, 384 aa, Bacillus thuringiensis; identical to SEQ ID NO: 14

SEQ ID NO: 372 - protein, 350 aa, Clostridium botulinum
MNKYTIAIDLGYGQIKGINQDNKRVIFPSIISSGKDRSLDTFFNSIDNIVDNIHVKILDEYFNEKEYFVGELAKRQPSNSSFINRDNKINSEENKVLLATALGLLIPNDLSNDTKIHIVTGLPLEHFIKQKQALNDMLKDFEHTIKFVDHNFSRNIKFEESNITLFPQGAGAIFSKINNDISSLLIKETFIGLIDVGFKTTDIVVFRINKDKEPVFEQEMSATLDGLGMINIYNTMDKAFTDNSRDGSKLNTEQLMLLCEEGKIFFKGDYIDLKKDLIKARKTLSTNIINKADGLWGSRKNSFNSIMIAGGGGKVLYNHLKLIEPNMCQLIDNPEFANAIGYLEFGKQFK

SEQ ID NO: 373 - protein, 392 aa, Bacillus coagulans
MGKTRIAAVDVGNDSLKGIFGKMEYELNIPNVIARDIEDRPVIGIEELDSKDPLEGIHVKVHSPALKENNVIYRVGDLATKSDNATELDPGSSKSEEDQTLVLLFTSLALDAVREENAKVFTRNQNVIDANYTLGTGLPLREVKEGKDAGYRSQLLGSVHQVEFLVTPKYQGLKVNLKFDEIKVYPEGFAAFINLVMDNDLNIINRELIDKRILIQDIGGLSTDIAVIKNRTVDDDRAQGFNLGVSEALEQIREEIRVKYGVELDSRRDVVDIITKKHDRNHIMVKGSRTSVHDITDRILFDLAKKQYRLLRNVWQKNSQTEICYFVGGGSVVLKDYLKTLNNSLDGYNIDFFEDEKESIWMMANAYYKLISDYVRKNNKPEDKGKKPVESK

SEQ ID NO: 374 - protein, 331 aa, Vibrio cholerae
MEDFMSQFVLGLDIGYSNLKMAMGYKGEEARTVVMPVGAGPLELMPQQLTGGAGTCIQVVIDGEKWVAGVEPDRLQGWERELHGDYPSTNPYKALFYAALLMSEQKEIDVLVTGLPVSQYMDVERREALKSRLEGEHQITPKRSVAVKSVVVVPQPAGAYMDVVSSTKDEDLLEIIQGGKTVVIDPGFFSVDWVALEEGEVRYHSSGTSLKAMSVLLQETDRLIQEDHGGAPGIEKIEKAIRAGKAEIFLYGEKVSIKDYFKKASTKVAQNALIPMRKSMREDGMDADVVLLAGGGAEAYQDAAKELFPKSRIVLPNESVASNARGFWFCG

SEQ ID NO: 375 - protein, 290 aa, Clostridium butyricum
MITVVDLGNYNVKAMNSLTAKSIFKSNISRDYESYPDAFKHIKIDGEYTYFEKGPFSMEYIKTKKDYTAQLMYAIASLNEAEDEIKTNLTLLLPISEIQEKHKYIDEIKGKTFNCSVKLKTKINKNITIEDVMVLPEGYVIYFKLGEKYKTSSIVIVDIGGRTTNLVAMVNGEPKVLKTLKIGALDFYAKIRELHADKEYNLEDIERLIKEGKVVVTDKQIAQFANDILNQIKQHIKLEHYEHVLFAGGGAIIIEKIIKDILPDNCEIVDEPLESNMEGAMEASKMAWNE

SEQ ID NO: 376 - protein, 302 aa, Helicobacter pullorum
MQKIAIDLGYGDTKVMANGKLFKFPSAISQVRQSLIQAEKKDTFLFNGIEYEVGSKALRNAVATRGYLFLQKYSPLLIFNALLEAQFDLKKPIEIATGLSLVNQSEAQDFLKHIESFVVNDIQIKPQISLFAQGQGIYNEANIQSNGLVCVIDIGYNTFDFLVFENNQPKVELCFANKMGANLAIVDLQKLLIKEFKVDFSEQEAKEVFLKKEVRIAGKSIDFADIVNSAIQNYTNFIFDELFSKSGDTLKKAEAVIIGGGGAYFLTKEHLEQVHNANYVFSDNPEFANVRGYYKGSFSNKE

SEQ ID NO: 377 - protein, 347 aa, Methylobacterium extorquens
MAEAAMKKERGAKEGVQPLVAIDDGYAQTKLYGEGLDGRIVKRVLRSSVRIGSHGLGSFAGDGAIGLWQTEEGNKYTVSDEIEAEDPRFTDFHLSPINRVLVNHALSAAGFGGAKVDIVTGLPVKEFFKEQRKDEERIQRKRENLQRGAFSRSAGVEAPVLADIQVGCQAIAAFVDWALDDEMKTRNDIAKTIAIVDIGGRTTDVAVVVGGKSIDHGRSGTADVGVLDVYKGVLDRVKGRFELDDDSLPLSLMNEAVRTGSMQLFGKPHDVSEIVSDVVGQVQERALREIQRRLGRAATLQAVVFVGGGSALFKDIASAYPNGVMSDDPEFANARGLYKYFASRRRS

SEQ ID NO: 378 - protein, 343 aa, Acidovorax delafieldii
MELIVRAVDVGSGNTKLVTGVAGADIRCASFPSVAYPSSGETPQWPASERRKTFCIPVGPLFYEVGPDVGLAADTFRAKQLHDEYTESPEYMALLRGALSMMKVPHIDLLIVGLPVALFTLKKAALEKAMVGSHQVGGGKTVTVAKAMAVAQPQGALVHYAAEHQKIESIGTEQSLVIDPGSRTFDWLVTRGMRLVQKQSHSINRGMSDVLRLLAAEVSKDLGTPYRDYDAIDLALRTGKAPVIFQKPYDMKRHLPLAESVAQQAVSTMRQWIETPESLQNIILVGGGAFLFKKAVKAAFPKHRIHEVKEPMFANVRGFQLAGQNYAASTMAPGRDRGAGEAA

SEQ ID NO: 379 - protein, 259 aa, Acidovorax delafieldii
MWERSLHADYTGTDSYKALFHAGLLLTSATEIDVLVTGLPVSQYQDESRRKALEKQFTGKRKITPKRTVEAASVKVVAQPIGGLFDMVNQDESQGEDGDIDEEARILVVDPGFFSLDWVLVSNGEFHRQSSDTSLKASSVLLEQAGLLIAQDYGAKPTVEALENAVRAGITSILMMGQRVDFGPYLKRAGESMSSTIANSIQKSLRNEKMSPDIVVLTGGGADFFRDIIQDAFPRLKVVSPKESVLSNARGFWLLGSIN

SEQ ID NO: 380 - protein, 295 aa, Clostridium cellulovorans
MIMGIDVGYSHTKVYTSNGRDIFRSTVTNGIMDINVNAIKVKIAGNEYTVGENTGNFSVKLNKIDDAVFRLCLYTAVARNLPIGEDEVQLVIGLPVQYYKDQKLELKKALEGIQVFLSLNDKPIRFKITKCVVFPQSAGVFVLHPDIFEGSNIVIDIGGMTVDVSYFNDMTLQDYRTYELGMIKLYDKLVQNIKAEFGVSYDILNAEDIIKNKRIFRDGELIDCTDVVNTTLRTHASLIINRVMAGLSQYDTSQRHFIGGGSYILGEYLPVKAIKEDIYANAEAFFKIGVERFAS

SEQ ID NO: 381 - protein, 288 aa, Clostridium cellulovorans
MILGIDIGNYSVKTSTGVNFKSLVSTEENLLGSKIKIEFDNKTFYIGEGNRDTELDKASKESFLPLLYSAIALSSPAQYNKVVVGLPINQYKSRKAEIENKISKESNKKIILNDKERTLTITEFKVYPEGVGAYQSLDSEEDMIIIDIGGRTTDIAYIFNGELKTTSTVNVGTLNIYKNIADQLNSKFSIDIDVEKAEKIIKQGYLSIDNKTVDISFVSSVLRENFMKIKADLDFKFSAHTEKLMLTGGGAALFHKAFVNRYEDISIMQNPVLANVRGFKKVGELLWV

SEQ ID NO: 382 - protein, 327 aa, Aeromonas hydrophila
MSQFVLGLDIGYSNLKMAMGHKGGEARTVIMPVGAGPLELMPQQLTGGAGTSIQVVIDGEKWVAGVEPDRLQGWERELHGDYPSTNPYKALFYAALLMSEQKEIDVLVTGLPVSQYMEVERREALKARLEGEHQITPKRSVAVKSVVVVPQPAGAYMDVVSSTKDEDLLEIIQGGKTVVIDPGFFSVDWVALEEGEVRYHSSGTSLKAMSVLLQETDRLIQEDHGGAPGIEKIEKAIRAGKGEIFLYGEKVSIKDYFKKASTKVAQNALIPMRKSMREDGMDADVVLLAGGGAEAYQDAARELFPKSRIVLPEESVASNARGFWFCG

SEQ ID NO: 383 - protein, 295 aa, Clostridium botulinum
MLIGVDLGNFGVNTSENDFFYSRISDISNFSEENKITYEGIDLYIGDGEFSTNWNKSQKENTMPLLFSALARSSNENFFQIVLGLPIQQYKSNKDEFKKYIEDNRGKTIIYKGIKREIIISDVLIAPEGAAAYYNLSAEQKKLIGNKSLIIVDIGGRTTDVCMFQNKEIKKFKTIPTGMLNIYADIVTEVNNRFTESFKLEEGENILKEGLFLYGEKQDINFVKPILQRHFNSIYKDLQLNFELSKGYVLLTGGGSLILKRPFENRLKNLIISKDPVFDNAKGFKKLGTSIWQEK

SEQ ID NO: 384 - protein, 305 aa, Clostridium botulinum
MSEKIKVLVSIVDLGNYNVKGINQDGKKIDFKSNISKNYETFPDGFNYVLLDGEYTYFEKGVFSKEYIKTNKDYTAQVLYAITKLHEDIEDIETNLTLLLPISEMEHKQKYIDELKGKTFEYTVKASKKMEKTVKINDVLVIPEGYASYFTLEDEVKTSAVLLIDVGGRTSNVVAMNNGKPQVLTTYKIGVLNFYSKLKKLNEDKEYNLEDIERLIKKGDITITQKQLATFTNDIINEIKIDVNLNHYDNVVWTGGGSTVIEKVITENLPESCSLNKEPLYSNINGALEVSKITWGIKDGKEEKK

SEQ ID NO: 385 - protein, 298 aa, Clostridium botulinum
MENNNGLVRITVVDAGNYNMKYMGKGEMGSFSSKVSTDEQPFNDAYDRIEIDGKITYIGQFGELSREYNKVDRNLLPQILFAICKANNDVDTITTNITTMLPILQMTNKSKIIEQLKSQNPFKVKVNGKDKTIFIKQVAVLPESFTSFYDMTKEQQKEDVCIVDCGSRTVNVCTFINNGKLEKTATLKLGSLDFFKKVKSIEASKGKDYVEEDIERLINNGKITVAEKQYKDFFNEILNSIKADVNIDNYATYFTGGTAKMFQKYIPNGCKLFVNPLYSNLNGALKASELKWGKVVNG

SEQ ID NO: 386 - protein, 347 aa, Leptospirillum ferrodiazotrophum
MKKAGQNKETLKIENIGLDDGYANIKLAWKDEDGTIRTKKVPSRAKAGSLGVGSLLDDGPGAAMGYETEGERWTVAPGIEGESTRFPDYNLSSLARVLAHHALVSAGWGGKDVGIATGLPLDRYFRDGKRDDVRIARKIENFSKDVIRLDGGATARIVGHEVFAQGLAAVVDWLVDDSDPREQIGPIGVVDIGGQTTDISVVSPGFQVDRGRVRTVDLGVLDVRDLLRRRLQSRFDVYEISDGAIDAALAFGKIRVWNKEVDVIDDTAQVVREVESSLERNILSEFGKAASSFETILFVGGGSRIFRSLPARFPNAVVGPDPEFANARGLLKIRILNERLNKRGSRS

SEQ ID NO: 387 - protein, 324 aa, Gallionella ferruginea
MLTVGLDIGYSNLKIVYGDNTEVSPKMIKRPAGAAPLDHLGQRIMGSDDSLHVLVDGKEFAAAVSHDRIENWPRELHKDYTATESYRALFNAGLLLTEMSEIDCVVTGLPTNQYLDAGLREHLTKIMRGEHQITPRRKVVVHEVKIVPQPLGGFVDWMHGLNDPSQIEDSSVLVVDPGFFSVDWVLLVNGEFKRASSGTSLDATSVVLDEAAALIAKDHGGNPGRSKLENAVRAERSTVSVFGERIEIAPYLADASAKVGHIACSQIQESLRKENSSIDQIVLVGGGAPFFEASIKEAFAKTPINLAKEAVFANARGFWRGGAA

SEQ ID NO: 388 - protein, 378 aa, Paenibacillus sp.
MIGNVLFPRCEEVIMIRIAGIDVGNDSVKVVVDGSQRPIIIPSIVSPGYDRHVLQEEDSPLKALDVRVYSPKLKRNNQRYFVGLLAMEDQDNSELEETDNKATSDQSLVVALTALAYAALAGQTYPTTGTGIEEVEYILGTGLPVRTYVAFHKAFEERLTGEHEVTFLSTPELRGRTVRINIRRTIVSVEGAAALFHLATNDTLQVRNEELHNGCIGICEIGALTTDFPVVKRMNIDNQFSTGEQFGLATYLDSIIRDVEDQFGYRFPSRTKLIGRIRNREFIIQRVGEGQADIRPIVDMYFSRAAQKLVDLIRKRWKKYPDIECFYVLGGGAAALKSYLIEAAGPMRLRFEENSEILNVQGYLKLAKNKAGQQPNPA

SEQ ID NO: 389 - protein, 348 aa, Clostridium botulinum
MSKGNNIVDSFAVQVIDDGYADTKSRSENTNIIVTPSYVTSWRPSYNKDNDLKEGKVDKLSRIEVNVNGSKFLVGECAVKQDRNIQWNGASDKHDDTSFDILLKTHLSLLNKKPMSRVKLVMGLPVIASLDKERVDKMKAKVLRQHDVAMRLCGDKEFQNKIIKVEDLIIKAQPHGTLCDLILDNSGNLTNKDLAKKVNAISDIGGKTHNLYLVDALEPLADFCDTKNSGMYLAYMWIKNYIEQELHLSISDGQIQYIVASGHIKGYDLTPVIQKAYRSLARKIILEIRTVWENAFPFIENIIFTGGGATVLKPYLQEEFKNAMYLTRNQNAAGLFKQGIRKWKRKAV

SEQ ID NO: 390 - protein, 341 aa, Bacillus anthracis
MKSLYAIDVGIGFTKRAYRQDEDSEVTVKSEASTLAPVPNHDESEDLTKVSFIDLDFAYYMGNEAHQSDASFLPPFEEEIENYYESEQFKQQIFGCIAKDYKENVVLPLVVTGLPVTYFGSQHEQLQRALKKETSVQIDGKFIHITVENALILQQPVALHAYFLKEGIIQERDRILIIDGGFRTLEMTDMKQNVILNHYETELGCSKPLKNIKNIVQNHAGESDHLHINDMPNILEKGYGGREEDPQTNQVHILIQKELDAHFQDVMRVLQEQFKLDQYDTIIWTGGIVDLHKKRIEKMQGEISSFRMVDASKEAALHGYYMIGSQVFDDITNQSVYESKL

SEQ ID NO: 391 - protein, 340 aa, Thermoanaerobacterium thermosaccharolyticum
MFKIGLDLGYGYTKGINESDKTVVFPSIVGNAYERNLKGLFESSFEKRIDNMHIVIMNGERHEFFVGELARREGRNVSYAFDENKINHPNTKALIAASCLLLFPEDGSPVHLVTGLPLEQYIHKKDEFLEMLKGYRNLGCFKGDEKVKTIKFDKVTIFPQAAGAVYSAIMEDLHRYLIKGSYLGLVDIGFKTTDFIVFLVEDRLILREDLSGTIDVGISSIYNSIDKLFIQKTGSKLDVPELMRLAKDERIFFRGRQIDFGDEIKSIKAEIARVIKDRLKAVWGNKLDFFNTIFLAGGGAKDLQEFLVDIYDNAVIVKDPQMANAKGFLKVAELEEKKNN

SEQ ID NO: 392 - protein, 391 aa, Bacillus subtilis; identical to SEQ ID NO: 1

SEQ ID NO: 393 - protein, 327 aa, Vibrio mimicus
MSQFVLGLDIGYSNLKMAMGHKGEEARTIVMPVGAGPLELMPQQLTGGAGASIQVVIDGEKWVAGVEPDRLQGWERELHGDYPSTNPYKALFYAALLMSEQKEIDVLVTGLPVSQYMEVERREALKARLEGEHQITPKRSVAVKSVVVVPQPAGAYMDVVSSTKDEDLLEIIQGGKTVVIDPGFFSVDWVALEEGEVRYHSSGTSLKAMSVLLQETDRLIQEDHGGAPGIEKIEKAIRAGKAEIFLYGEKVSIKDYFKKASTKVAQNALIPMRKSMREDGMDADVVLLAGGGAEAYQDAAKELFPKSRIVLPNESVASNARGFWFCG

SEQ ID NO: 394 - protein, 360 aa, Lactobacillus antri
MQYSAKQGEQPMEIFSLDLGNKQTKLKSSKSEYVLPSRYLNQADMPMSVGSSTTNNDLHIYSVPFSDDKYVWGRDIDGLHLDEYLADTIMYGNRYNSEAFKLLANFALGLLASDFKIANNQVLEVVVTAGLPTGDYADQERLRSLLKVLEGQHQVTIDDQIVTVRVRKVYILPQPIGTLYNELLDNQGFIKNKALLDEKVGIVDVGGGTILIDTILNFELSGKNRHQFNTGVNDLYEAIASRIEGDVSLYQLEKELRHGNQQHQWSYRFSKNRQDDITELVGKESDRFTRRLVANVTSTLKNLDSIDTLFFTGGGANLINQKILKTTFTNAAIVKDTEVANVNGFYKYGLSQQVQEKEGK

SEQ ID NO: 395 - protein, 324 aa, Vibrio cholerae
MFVLGVDIGYSNLKLAIGQSGSEPKTIILPAGAGPADRMPERIGGGDDETCLYVSVDNERWAAGVPAGRLQGWERELHPEYPTTKTYKALFHAALLMAETESIDLVVTGLPVSQFHEPQRKSDLVQRLKGVHQVTPKRSITVHDVRVLPQPAGAYMDLVQTGGDLGLIEEGRVVVIDPGFFSVDWVALEAGEIRYSSSGTSLQAMSVLLETIDKLISEDHGAKVGMDRLEKAMRTSDLQVLLFGEKVDISPYLNAAMKKVAPVALTAMRQSMRDESINADLVLIAGGGAMAYKEAAKEIFSRSKIIVPEQSVLANVRGFWFYGA

SEQ ID NO: 396 - protein, 366 aa, Lactobacillus helveticus
MWYSVYTQNNAIQGECFMDIFSLDLGNKQTKLKSSKAEYVLPSRYLNQADMPMSVGNSTMNNDLHTYSVPFSDDKYVWGRDIDRLHLDEYLADTIMYGARYNSEAFKLLANFALGLLASDFKAAKDQVLEVVVTAGLPTGDYADQGQLKALLKVLEGQHQVTIDDKIVTVRVRKVYILPQPIGTLYNELLDDEGFIQNKNLLDEKVGIVDVGGGTILIDTILNFELSGKNRHQFNTGVNDLYEAIANGINGDTSLYQLEKDLRKGNQQHHWSYRFSKNRQDDITDLVCKEIDRFTRRLVANVTSTLKNLNSIDTLFFTGGGANLLNQKILNTTFTNAVIVKNTEVANVNGFYKYGLSQQAKNEGGK

SEQ ID NO: 397 - protein, 324 aa, Ammonifex degensii
MKVAIDVGYGFVKGVAGSGERVRFPSVVAPAQELVLSDLAGREVGHLVELRRLSGAVERYFVGELALKEGRAQAVTLDRDKHLHPYHSVLLLAAARLLGAGSSAELCVGLPVAYYRPRREELKRHLMGLSAEVSVDGSPAARVSFSRVLVYPQGAGALLTAADLPESGLTVTVDVGFKTTDFVTCEVQDGKALPVSSLCGSLEVGVHTALYLVQAAYQARTGAPLDFTRAERLLREGRTFFRGEELDFSREAEMARLAAARSIADGVLAVLGSRADEVAVYYLAGGGAEALPQLRQMLPGRVRVLPDPTFANALGFLKVLSGSA

SEQ ID NO: 398 - protein, 383 aa, Cylindrospermopsis raciborskii
MTEPTPAANPINLAAVPMNSGISKQTVSSISLTHKPTSSSGKNILSVDLGRTSTKTCVSREPGTVAFIPANVKHMSTEQIRSGVFESKTADPIIDLWLEYQGSGYAVGQLAADFGANLGVGKSKVEDALVKVLAAVGYFKLQGEISVVLGLPFLSLEQFEKEKAQLVSLLTGPHTVKFRGESLLISITKVWVMPEGYGSLLWTESQPNKSPLVPDLTTISVGIVDIGHQTIDLIMVDNFRFARGLSQSEDFAMSEFYQRVAGEIEGADSQSLALISAVNKPKGERFYRPKGATKPTNLDDFLPNLTEQFSREICSRVLAWLPDRVTDVIITGGGGEFFWADIQRLLKEARINAYLAAPSREANALGQYLYGEAQLSTSRVANQ

SEQ ID NO: 399 - protein, 384 aa, Raphidiopsis brookii
MTESTPVANPINLAAVPMNSGISRPTVPSISSAHKPTTTSGKNILSVDLGRTSTKTCITREPGTVVFIPSNVKHMSAEQIRSGVFESKTADPLMDLWLEYQGSGYAAGQLAADFGADLGVGKSKVEDALIKVLAAAGYFKLQEEISVVLGLPFLSLEQFEKEKAQLISLLTGQHIVNFRGESISVSITKVWVMPEGYGSLLWTESQPNKSPLVPDLTKISVGIVDIGHQTIDLIMVDHFRFARGLSQSEDFGMSEFYQRVAGEIEGADSQSLALISAVNKPKGERFYRPKGVTKPTNLDDVLPNLTEQFSREICSRVLAWLPDRVTDVIITGGGGEFFWGDIQRLLKEAKINAYLAAPSREANALGQYLYGEAQLSSSRGVARQ

SEQ ID NO: 400 - protein, 424 aa, Lactococcus lactis
MNIFAIDLGNKRIKMKSEKGEYSYPSSYLNAEQVATGGLGSESVEQNFVFKIPQDAKNSFIWGPNLEVYNLPERMIDTYARSGRMKQKKAIRILEFALGRLAMDYPEAYESPLVVHLTLGLSITDMHEESDTIDVLKKLAIGQHQILIDGRVLTIIIPTEEFLSIIPQYMGTVLNLAFDEEYQRNQRFSDGKIGVIDIGGGTILINRSVGLNPSPNGDERFEGIQNLIKEIGRRINSTKPFLIEQMLRSADDKGNYNYRPNSNRQDSRDITSVVRGEIERYTRFTVAPLVTENFPDIEEIDFIVVTGGGASLLAKEALKDEIGEEYFERLFFLNESEFANVRGFYKGGYLKWHISNDDSLQIKNSLEKVQTSLTNFEAFQDEKELVIPSNETINTLRSQEVLEAQKKLQALESEIEGIKLEFED

SEQ ID NO: 401 - protein, 325 aa, Bacillus cellulosilyticus
MKEQILIAVDCGKYQTKGIARYRGKTFMVSFRTKMMPVSRLGVDIQPNSFLVEYLGNEYLIGNMVSEDFVDYSLTKNSTIHQISIYTAISQLLQKANAPANVDIRLAVNVPISTYKDSVQKDSFKQMVENRRGSIHLLVNGRTHSFELSDVTLAFEGMGEVYSKPDVYKDKNTIVVDLGGLNTTLCTFSGIQPLVNTMIVSDLGINVLKGRIGKAINERYGLSVSADDLEQVLRSGYFASKGEVFEESKVFIEELKYDHVQQIIRFARSRGYTFNMSDIHFVGGGAIILKRYIKQEFPHAVILDNPQYSNCLSFLKILEVKYAKH

SEQ ID NO: 402 - protein, 372 aa, Arthrospira platensis
MQSNKQPGQSQSQSPLAKATTTKPTTTTVVGRSTILSVDLGRTATKSCISRNPADVVFIPSNVAQLSVEKARGGGFESKNTDPLLDLWLEYQGNGFAVGQLAADFGASLFGVDPAANPSKVNDALIKIFACVGYFNLKGDLDVVLGLPFYSQEQFEREKEQIMSLLSGPNTLVFRGEQVVVDIQSVRVMPEGYGSLIWCEAQGSKDMPNFADLSVAIVDVGHQTTDFLTVDRFRFARGVSQSEVFAMSKFYEEVAAKIEGADAQSLFLLEAVHKPQGQRFYRPRGATKPANLDEIVPELRKIFARDLCDRVVKWLPERVTDVVITGGGGEFFWQDLQPLLKEAQLRAHLTQPARKANSLGQYVYGEAQLAKR

SEQ ID NO: 403 - protein, 318 aa, Desulfurispirillum indicum
MKCIGQDIGFGDVKTVIEDQMLKTPTAIAYEGFGARVDLDGPTSIEFEGQNYLVGEDAIESGQPVFETTSIDFLLRYAPLLAYHAIKAAGFDFDEKIHLGVGLPVSYYTPENKAALANRLNTAVVNKERLQLNTLVYPQGVGAFYDYRLTTNEKISSALIVDIGYNTVDVVHISKGRPNKSGSGMFDRAGISVIIRELSRFISDRHQIQLSNQVIKEIFISKKLSLYGKEISLEEPIRQIVERYTTHLLHSLEDGYHQQLAQAQKIVITGGVAHYLQHYIPTKMQESIVIPESPEFANARGFYKVLIASISDSENVDA

SEQ ID NO: 404 - protein, 398 aa, Bacillus pseudofirmus
MTKSRIAAIDVGNDSVKALFGKADFELNIPNVIARDTEDRPVIGIEELNDKDPLEGIHIRVHSPALNDNNAIYRVGNLATKSDNATELDPGSSKSEEDQTLVMLFATLALDAVRAENGELFKKSNQVIDANYTLGTGLPLREVKEGKDVGYRSQLLSSVHQVEFLVTPKYQGLKVNIRFDQVKVYPEGFAAYINLVMDKDLNIINRDLVDKRILIQDIGGLSTDIAVIKNRNVDDDKAQGFNLGVSESLEAIREEIRTKHGVELDTRRDVVEVITKKQDRNHIMVKGSRTSVHDITDRILFELAKKQYRHLRNVWQKNSQTEICYFVGGGAMVLKEYLKTLNNNLDGYNIAFFEDEKESIWMMANAYYKLIADFDRKNNQVAAAKDPQSHQEKKAAKK

SEQ ID NO: 405 - protein, 399 aa, Bacillus pseudofirmus
MIVMNMNVANDNGNNEQAIKVNDVLYRQPNTYAMPERPSFEDNSEPETLIPNLLNELEVDIQSDSIDFGGLYFIGRKAIKSKYTAHSMSVDSEKKYESDLPIINTLGLLSGVAVQNAYKESKELPKEISLNVDMATALPVNQWSRETASFFSKRFMEGLHTVIVYVGHLKVRVSMKFTYVKVIPEGTPVLFNLIEDQEGNYRNDSIFDEFKKEYEVNVDGEYFQDKRIKHVDIGDGTCDTPLTIGYEYDRDFVNGIPTGIGHSINKAIDLFKKEVSDMNISRQQFIDYVKEEGHPYHDKAVRLIKQSMRSEVKSIHDHIVDELKKASNEVDIICVYGGGSILMKDHLYKPLKKLCDRPDIPAKLLWVPEQFAPLMNVEGLNIFLKAVLPQLKEKELASK

SEQ ID NO: 406 - protein, 362 aa, Xenorhabdus nematophila
MGNYRGYTGRSQAVFSLQQEENNRKAIKKQSLEDFMNQFVMGLDIGYSNLKMAMGHKGEEARTVVMPVGAGPLELMPQQLTGGAGTCIQVVIDGEKWVAGVEPDRLQGWERELHGDYPSTKPYKALFYAALLMSEQKEIDVLVTGLPVSQYMEAELREALKARLEGEHQITPKRTVTVKSVVVVPQPAGAYMDIVSSTKDDDLLEIIQGGKTVVIDPGFFSVDWVALEEGEVRYHSSGTSLKAMSMLLQETNRLIQEDHGGAPGIEKIEKAIRAGKTEIFLYGEKVSIKDYFKKASAKVAQNALVPMRKSMREDGMDADVVLLAGGGAEAYQDAAKELFPKSRIVLPKESVASNARGFWYCG

SEQ ID NO: 407 - protein, 338 aa, Burkholderia sp.
MKVSAFGVDIGYGHTKVALRTGSEISTASFPSLAPLVPHLELSRTRERVADGLNVVLIEVQGSHYAVGPEVESLPACSSLTRTSLDSFCLTPMYTALLGGALYRAGATEIECMVLGLPARFSWVYFRYLRDAFTGALDFGQGVIHVGSVDVVPPLLGSLGTFANSGDGRFDPEHGHLLIDVGYSETSWLLYCDHKIVPQCSGHVRGGAWQVYRTIGSLIANRERCPVDNMERIGRCLSDKKPLLHYGKDIDLAPLVESSQAVVSAAFEIIRDRTPSPSRLKSIVLTGGGASLYETAIRAAFPRVRIDILDAPSHANAKGFLLLGEAQLAGRKLVPTSA

SEQ ID NO: 408 - protein, 267 aa, Deferribacter desulfuricans
MRKVISIDIGFGSTKVAFNEGSGLRLEKFPTAIAPIPSSNHFNDNFYQEDKHFYFEGQLYTVGDAAKADAIVTTSYEFLHKYSPLILYYIIEKFNIDYSNAVFALGLPLSYYTNDKINEMSNRLKSFTVNDVEISIDVKILVQGVGCLFDYLSTNQSNVKNGIVVDIGYNTIEFIVIQNGKVKKADSRGLVKKGMNMLIVKLQQEIQSKYALELTEHEAVSALEDESINLYGNKIPLKEDIIKLKKWYTDTVIQNLIGMYDDKNKEI

SEQ ID NO: 409 - protein, 381 aa, Eubacterium rectale
METSIFATKSEIREHKNPSFGNVHIIGLDMGYSGVKCFHENGNFVFPNYCQKIEGEIFGDLSRNDLIYEDLKSGDRYYVGALAIKSLSEDSTVAEDKILGRNHYGHMDFLIKFRTALGLARWDIPEDEPLFIQTGLPPAYIKTDEMLLRNAIQQSHDFALISCGKRKEFHIDITAEDVDVMYQPMGTFYSVTTDQFGNLTNDLKTFRNSDLLVFDCGFKTLDKFVIQNKKLEEKDTDENLGMKRILEETRNSMQEDLKKKGYSVSVSLPAMQQCLKNGVVRINDRINFTVKEFPIEEYLKKANELICKEAFDSIKDYVFSIKYLIMTGGTGSAWYGYFKDKLKGIHTLKVISGDYNSNLPAFYANARGYYMYRLTQFKVKR

SEQ ID NO: 410 - DNA, 1176 bp, Bacillus subtilis
atgaatatttctcgtatgaacgtggactttggaaacagtatgtacatgaatttaattgatggttatttttttgaattgcctacaaatgtagtagagatatctaaagaagctgctgaaggaaaatttacgagtatcgttgaagatccggcagatttaaaggaccggttattagtttctacagttattgatgaaacagagagatattttctagttggtgaacttgctgaaccagaagtgttaggcaaccaacacatcaagaagttacataataaagtagagtcacatattccatacgtaacatttttagctgcaactgcttattaccaagcgctaaaaggcaaacgtgaagataatgaagttactattgaatactttcaaacaatgctaccaatttggcttcttaaaaaattggataagttcagtgaaatgcagaaaaggatggcatctaaatttttgggcactcaccaagtaaaggtgctgacattaggattagaaaaagagcttactataaaagtggaagatgcagcgtgcaggatcgaatctgaagtagcaagatgggcaataaagaaaaactttgacctagaagataaagactatgccgaacaatttaaaaattatgacgtagttttttgtgatttaggtggcggaacagatgatctagtattactaccagctggattaaaaccgccaaaaagtcgtgattcttttgtttctaataccgaagcaccgtttttagcgcacttagaaaaattgagaaaagaaaaactcctagagcactttgatagcgttagggagcttgaaaagtttatatactcaaatattggaaaaactaagatggaacgaagagacgggaataccggtcagaaatttgatttaactgatatcatcaaaaaatctcttaaagaatacacagaaatcaaaatagcccaagctgaaaatacgttccctgcaccaaaagataaggtttacaaatacctttattttggcggtgttggcgaggtgcttgaagaatcaattagtgtggttactgaagagagatatggccgtgatatttctgaatcaaatcatatagttgctgaggatgcaagactgctcaacttatatggccttgaagttttaagccgcgctgaacaagtaaagaaacaggcaaatgaaaaagaggcacaatcaatttag

SEQ ID NO: 411 - protein, 134 aa, Bacillus subtilis
MGKNKRIPLFNVRTTQMSDEMYDFVLEQISTFSKGKSKGTFREYAFQLIERDMQQQKEEQQNREKDRHVHDELIAMREEMKKEFRDLRKKIDQGSIYVEHKTADPKSASETIEEGQLITEKITGTIEEEYDYDF

SEQ ID NO: 412 - protein, 11 aa, Artificial Sequence
  synthetic human beta actin phosphate 1 region
LVVDNGSGMCK

SEQ ID NO: 413 - protein, 8 aa, Artificial Sequence
  synthetic human beta actin connect 1 region
VAIQAVLS

SEQ ID NO: 414 - protein, 17 aa, Artificial Sequence
  synthetic human beta actin phosphate 2 region
TGIVMDSGDGVTHTVPI

SEQ ID NO: 415 - protein, 11 aa, Artificial Sequence
  synthetic Bacillus subtilis MreB phosphate 1 region
LGIDLGTANTL

SEQ ID NO: 416 - protein, 8 aa, Artificial Sequence
  synthetic Bacillus subtilis MreB connect 1 region
PIEEPFAA

SEQ ID NO: 417 - protein, 17 aa, Artificial Sequence
  synthetic Bacillus subtilis MreB phosphate 2 region
GSMVVDIGGGTTEVAII

SEQ ID NO: 418 - protein, 11 aa, Artificial Sequence
  synthetic Escherichia coli plasmid R1 ParM phosphate 1 region
VFIDDGSTNIK

SEQ ID NO: 419 - protein, 8 aa, Artificial Sequence
  synthetic Escherichia coli plasmid R1 ParM connect 1 region
VMPESIPA

SEQ ID NO: 420 - protein, 17 aa, Artificial Sequence
  synthetic Escherichia coli plasmid R1 ParM phosphate 2 region
SLLIIDLGGTTLDISQV

SEQ ID NO: 421 - protein, 11 aa, Artificial Sequence
  synthetic Bacillus subtilis FtsA phosphate 1 region
VSLDLGTSNTK

SEQ ID NO: 422 - protein, 8 aa, Artificial Sequence
  synthetic Bacillus subtilis FtsA connect 1 region
ICLQPLAA

SEQ ID NO: 423 - protein, 17 aa, Artificial Sequence
  synthetic Bacillus subtilis FtsA phosphate 2 region
GVALIDIGGGSTTIAVF

SEQ ID NO: 424 - protein, 11 aa, Artificial Sequence
  synthetic Magnetospirullum gryphiswaldense MamK phosphate 1 region
LGIDLGTSHTA

SEQ ID NO: 425 - protein, 8 aa, Artificial Sequence
  synthetic Magnetospirullum gryphiswaldense MamK connect 1 region
VVSEPFMV

SEQ ID NO: 426 - protein, 17 aa, Artificial Sequence
  synthetic Magnetospirullum gryphiswaldense MamK phosphate 2 region
NTIIVDIGAGTTDICAL

SEQ ID NO: 427 - protein, 11 aa, Artificial Sequence
  synthetic Bacillus subtilis natto plasmid pLS32 AlfA phosphate 1 region
TVIDIGNFSTK

SEQ ID NO: 428 - protein, 8 aa, Artificial Sequence
  synthetic Bacillus subtilis natto plasmid pLS32 AlfA connect 1 region
MAAEGLGA

SEQ ID NO: 429 - protein, 17 aa, Artificial Sequence
  synthetic Bacillus subtilis natto plasmid pLS32 AlfA phosphate 2 region
NCVIVDAGSKTLNVLYL

SEQ ID NO: 430 - protein, 11 aa, Artificial Sequence
  synthetic Bacillus subtilis natto plasmid pLS32 Alp6A phosphate 1 region
FGCDIGFKQFK

SEQ ID NO: 431 - protein, 8 aa, Artificial Sequence
  synthetic Bacillus subtilis natto plasmid pLS32 Alp6A connect 1 region
VVPQGAGD

SEQ ID NO: 432 - protein, 17 aa, Artificial Sequence
  synthetic Bacillus subtilis natto plasmid pLS32 Alp6A phosphate 2 region
KTVIVNIGYRTTEIVTM

SEQ ID NO: 433 - protein, 11 aa, Artificial Sequence
  synthetic Bacillus subtilis natto plasmid pLS32 Alp7A phosphate 1 region
MNVDFGNSMYM

SEQ ID NO: 434 - protein, 8 aa, Artificial Sequence
  synthetic Bacillus subtilis natto plasmid pLS32 Alp7A connect 1 region
CRIESEVA

SEQ ID NO: 435 - protein, 17 aa, Artificial Sequence
  synthetic Bacillus subtilis natto plasmid pLS32 Alp7A phosphate 2 region
DVVFCDLGGGTDDLVLL

SEQ ID NO: 436 - protein, 11 aa, Artificial Sequence
  synthetic Bacillus subtilis natto plasmid pLS32 Alp8A phosphate 1 region
VGLDIGYSNVK

SEQ ID NO: 437 - protein, 8 aa, Artificial Sequence
  synthetic Bacillus subtilis natto plasmid pLS32 Alp8A connect 1 region
VLSQGVGI

SEQ ID NO: 438 - protein, 17 aa, Artificial Sequence
  synthetic Bacillus subtilis natto plasmid pLS32 Alp8A phosphate 2 region
NILVIDPGYYSMDYVTF

SEQ ID NO: 439 - DNA, 36 bp, Artificial Sequence
  synthetic PCR amplification oligonucleotide primer P1
ctgtaggtaccgccatagatatgtagtacaacaatc

SEQ ID NO: 440 - DNA, 30 bp, Artificial Sequence
  synthetic PCR amplification oligonucleotide primer P2
gactatcgatgccatgtgcaatcagccttc

SEQ ID NO: 441 - DNA, 36 bp, Artificial Sequence; identical to SEQ ID NO: 439
  synthetic PCR amplification oligonucleotide primer P3

SEQ ID NO: 442 - DNA, 28 bp, Artificial Sequence
  synthetic PCR amplification oligonucleotide primer P4
aatcgcggtaccattatttgtagagctc

SEQ ID NO: 443 - DNA, 31 bp, Artificial Sequence
  synthetic PCR amplification oligonucleotide primer P5
ctgtaagcgctgctaatgtggaaggaacaag

SEQ ID NO: 444 - DNA, 41 bp, Artificial Sequence
  synthetic PCR amplification oligonucleotide primer P6
gtactcggccgatcgatgctagctgtctctggcactttatg

SEQ ID NO: 445 - DNA, 34 bp, Artificial Sequence
  synthetic PCR amplification oligonucleotide primer P7
ctgtaggtaccgtagtgcgccaagcaacctagtg

SEQ ID NO: 446 - DNA, 47 bp, Artificial Sequence
  synthetic PCR amplification oligonucleotide primer P8
gtactatcgatgctagcaattgattgtgcctctttttcatttgcctg

SEQ ID NO: 447 - DNA, 39 bp, Artificial Sequence
  synthetic PCR amplification oligonucleotide primer P9
ctgtaggtacctaatgagatgctagtattgaggaaagtg

SEQ ID NO: 448 - DNA, 33 bp, Artificial Sequence
  synthetic PCR amplification oligonucleotide primer P10
gtactgcatgcgttgctcagggcgtctgtgttg

SEQ ID NO: 449 - DNA, 51 bp, Artificial Sequence
  synthetic PCR amplification oligonucleotide primer P11
ctgtaatgcattcattagcctccaatcttatagtgaaactccgcaaacttc

SEQ ID NO: 450 - DNA, 33 bp, Artificial Sequence
  synthetic PCR amplification oligonucleotide primer P12
gtactgctagcgttgctcagggcgtctgtgttg

SEQ ID NO: 451 - DNA, 53 bp, Artificial Sequence
  synthetic PCR amplification oligonucleotide primer P13
gagagaataaaaatatgaatatttctcctagggaggcacaatcaatttaggtg

SEQ ID NO: 452 - DNA, 53 bp, Artificial Sequence
  synthetic PCR amplification oligonucleotide primer P14
cacctaaattgattgtgcctccctaggagaaatattcatatttttattctctc

SEQ ID NO: 453 - DNA, 27 bp, Artificial Sequence
  synthetic PCR amplification oligonucleotide primer P15
atcaatgcatctgtagacaaattgtga

SEQ ID NO: 454 - DNA, 28 bp, Artificial Sequence
  synthetic PCR amplification oligonucleotide primer P16
atcaatgcatgctggatacttcccgtcc

SEQ ID NO: 455 - DNA, 39 bp, Artificial Sequence
  synthetic PCR amplification oligonucleotide primer P17
gaggcacaatcaatttagtgaattcgagcactagtgcag

SEQ ID NO: 456 - DNA, 39 bp, Artificial Sequence
  synthetic PCR amplification oligonucleotide primer P18
ctgcactagtgctcgaattcactaaattgattgtgcctc

SEQ ID NO: 457 - DNA, 33 bp, Artificial Sequence
  synthetic PCR amplification oligonucleotide primer P19
ctgtaactagtgatgctagtattgaggaaagtg

SEQ ID NO: 458 - DNA, 21 bp, Artificial Sequence
  synthetic PCR amplification oligonucleotide primer P20
gagtcttgccttttgggttag

SEQ ID NO: 459 - DNA, 40 bp, Artificial Sequence
  synthetic PCR amplification oligonucleotide primer P21
gacgtagttttttgtgcattaggtggcggaacagatgatc

SEQ ID NO: 460 - DNA, 40 bp, Artificial Sequence
  synthetic PCR amplification oligonucleotide primer P22
gatcatctgttccgccacctaatgcacaaaaaactacgtc

SEQ ID NO: 461 - DNA, 32 bp, Artificial Sequence
  synthetic PCR amplification oligonucleotide primer P23
gcagcgtgcaggatcgcatctgaagtagcaag

SEQ ID NO: 462 - DNA, 32 bp, Artificial Sequence
  synthetic PCR amplification oligonucleotide primer P24
cttgctacttcagatgcgatcctgcacgctgc

SEQ ID NO: 463 - DNA, 39 bp, Artificial Sequence
  synthetic PCR amplification oligonucleotide primer P25
ctgtagctagcaatatttctcgtatgaacgtggactttg

SEQ ID NO: 464 - DNA, 44 bp, Artificial Sequence
  synthetic PCR amplification oligonucleotide primer P26
gtactgctagcctaaattgattgtgcctctttttcatttgcctg

SEQ ID NO: 465 - DNA, 30 bp, Artificial Sequence
  synthetic PCR amplification oligonucleotide primer P27
tttgaattcatggaactgctccgcaaagga

SEQ ID NO: 466 - DNA, 43 bp, Artificial Sequence
  synthetic PCR amplification oligonucleotide primer P28
tttctgcagtgcagccgcatctgactggctgctgagcttattc

SEQ ID NO: 467 - DNA, 31 bp, Artificial Sequence
  synthetic PCR amplification oligonucleotide primer P29
gtactagatctcaagactctccgtagtttag

SEQ ID NO: 468 - DNA, 31 bp, Artificial Sequence
  synthetic PCR amplification oligonucleotide primer P30
ctgtaagatctcataaatcgccgtgacgatc

SEQ ID NO: 469 - DNA, 30 bp, Artificial Sequence
  synthetic PCR amplification oligonucleotide primer P31
cccggaattcgatcccctccgccgctacca

SEQ ID NO: 470 - DNA, 32 bp, Artificial Sequence
  synthetic PCR amplification oligonucleotide primer P32
cccgcggatcctgctttttccattcctctcat

SEQ ID NO: 471 - DNA, 31 bp, Artificial Sequence
  synthetic PCR amplification oligonucleotide primer P33
gggactagtaagggcgaggagctgttcaccg

SEQ ID NO: 472 - DNA, 31 bp, Artificial Sequence
  synthetic PCR amplification oligonucleotide primer P34
acggccgcttgtacagctcgtccatgccgag

SEQ ID NO: 473 - DNA, 20 bp, Artificial Sequence
  synthetic PCR amplification oligonucleotide primer P35
ccactgtaagttctgccgaa

SEQ ID NO: 474 - DNA, 38 bp, Artificial Sequence
  synthetic PCR amplification oligonucleotide primer P36
ggggatccatgaaaccagtaacgttatacgatgtcgca

SEQ ID NO: 475 - DNA, 37 bp, Artificial Sequence
  synthetic PCR amplification oligonucleotide primer P37
tttagatcttccaccttttcccaagcttaataaattc

SEQ ID NO: 476 - DNA, 30 bp, Artificial Sequence
  synthetic PCR amplification oligonucleotide primer P38
gctgtcaaacatgagaattcttacattgta

SEQ ID NO: 477 - DNA, 79 bp, Artificial Sequence
  synthetic PCR amplification oligonucleotide primer P39
ttaagcttaaaggaggaaaataatgaaaaatattgaaaaagtaagcatgaaaccggttacgttatacgatgtcgcagag

SEQ ID NO: 478 - protein, 8 aa, Artificial Sequence
  synthetic 8 codons appended to the beginning of lacI gene
MKNIEKVS

SEQ ID NO: 479 - protein, 6 aa, Artificial Sequence
  synthetic hexahistidine tag
HHHHHH

What is claimed is:

1. An isolated recombinant plasmid expression vector comprising a polynucleotide encoding a prokaryote-derived actin like protein (ALP) having at least 90% identity to the polypeptide sequence of SEQ ID NO:1, wherein the ALP confers stability on a mobile genetic element when the ALP is expressed in a prokaryotic cell having a mobile genetic element.

2. The vector of claim 1, wherein the vector encodes an ALP7.

3. The vector according to claim 1, wherein the ALP comprises: D at the residue corresponding to human beta actin residue 11, G at the residue corresponding to human beta actin residue 13, E or Q at the residue corresponding to human beta actin residue 137, D at the residue corresponding to human beta actin residue 154, and G at the residue corresponding to human beta actin residue 156, when optimally aligned with the polypeptide sequence of human beta actin.

4. The vector of claim 1, further comprising a polynucleotide encoding a polypeptide sequence having at least 90% identity to SEQ ID NO:411.

5. The vector of claim 1, further comprising a polynucleotide sequence that encodes a heterologous polypeptide.

6. The vector of claim 5, wherein the heterologous polypeptide is competence factor K (comK).

7. The vector of claim 6, further comprising an origin of transfer.

8. An isolated bacteria comprising the plasmid expression vector of claim 1.

9. The bacteria of claim 8, wherein the bacteria is a *Bacillus* or *Escherichia* strain.

* * * * *